(12) United States Patent
Shen et al.

(10) Patent No.: US 9,963,707 B2
(45) Date of Patent: May 8, 2018

(54) MULTIPROTEIN EXPRESSION CASSETTES

(71) Applicant: AGRIVIDA, INC., Medford, MA (US)

(72) Inventors: Binzhang Shen, Boston, MA (US); Jason Donald, Lexington, MA (US); R. Michael Raab, Arlington, MA (US)

(73) Assignee: AGRIVIDA, INC., Medford, MA (US)

( * ) Notice: Subject to any disclaimer, the term of this patent is extended or adjusted under 35 U.S.C. 154(b) by 240 days.

(21) Appl. No.: 14/433,113

(22) PCT Filed: Oct. 3, 2013

(86) PCT No.: PCT/US2013/063298
§ 371 (c)(1),
(2) Date: Apr. 2, 2015

(87) PCT Pub. No.: WO2014/055778
PCT Pub. Date: Apr. 10, 2014

(65) Prior Publication Data
US 2015/0267206 A1      Sep. 24, 2015

Related U.S. Application Data

(60) Provisional application No. 61/783,424, filed on Mar. 14, 2013, provisional application No. 61/744,863, filed on Oct. 3, 2012.

(51) Int. Cl.
| | | |
|---|---|---|
| *C12N 15/63* | (2006.01) | |
| *C07K 14/81* | (2006.01) | |
| *C12N 9/20* | (2006.01) | |
| *C12N 9/42* | (2006.01) | |
| *C12N 9/24* | (2006.01) | |
| *C12N 9/50* | (2006.01) | |
| *C12N 9/54* | (2006.01) | |
| *C12N 9/64* | (2006.01) | |
| *C12N 15/62* | (2006.01) | |

(52) U.S. Cl.
CPC ............ *C12N 15/635* (2013.01); *C07K 14/81* (2013.01); *C12N 9/20* (2013.01); *C12N 9/248* (2013.01); *C12N 9/2437* (2013.01); *C12N 9/50* (2013.01); *C12N 9/54* (2013.01); *C12N 9/64* (2013.01); *C12N 15/62* (2013.01); *C12N 15/63* (2013.01); *C12Y 304/21062* (2013.01)

(58) Field of Classification Search
None
See application file for complete search history.

(56) References Cited

U.S. PATENT DOCUMENTS

| | | | |
|---|---|---|---|
| 5,543,302 | A | 8/1996 | Boguslawski et al. |
| 7,658,965 | B2 | 2/2010 | Sjoeholm et al. |
| 8,420,387 | B2 | 4/2013 | Shen et al. |
| 2003/0086918 | A1 | 5/2003 | Lima et al. |
| 2004/0091966 | A1 | 5/2004 | Zeidler et al. |
| 2006/0147499 | A1 | 7/2006 | Oestergaard et al. |
| 2008/0115243 | A1 | 5/2008 | Raab et al. |
| 2010/0251418 | A1 | 9/2010 | Snell |
| 2011/0111442 | A1 | 5/2011 | Shen et al. |
| 2011/0138502 | A1 | 6/2011 | Raab |
| 2015/0232503 | A1 | 8/2015 | Pallisse Bergwerf et al. |

FOREIGN PATENT DOCUMENTS

| | | |
|---|---|---|
| EP | 0415296 B2 | 8/1990 |
| WO | 1998/55634 A1 | 12/1998 |
| WO | 2000/52155 A2 | 9/2000 |
| WO | 2003/066861 A1 | 8/2003 |
| WO | 2004/034776 A2 | 4/2004 |
| WO | 2007/095398 A2 | 8/2007 |
| WO | 2011/057163 A2 | 5/2011 |
| WO | 2012/027395 A2 | 3/2012 |
| WO | 2012/042037 A1 | 4/2012 |
| WO | 2013/045632 A1 | 4/2013 |

OTHER PUBLICATIONS

Fastrez, J., "Engineering Allosteric Regulation into Biological Catalysts," Chem Biochem., Nov. 24, 2009, vol. 10, No. 18, pp. 2824-2835; p. 2831, left column first paragraph; figure 4, DOI: 10.1002/cbic.200900590.
Carvajal-Vallejos et al., "Unprecedented Rates and Efficiencies Revealed for New Natural Split Inteins from Metagenomic Sources"; Journal of Biological Chemistry, vol. 287, No. 34, (Aug. 17, 2012), pp. 28686-28696.
Wood et al., "A genetic system yields self-cleaving inteins for bioseparations"; Nature Biotechnology (XP-002157634), vol. 17, Sep. 1999, pp. 889-892.
Zeidler et al., "Temperature-sensitive control of protein activity by conditionally splicing inteins"; Nature Biotechnology, vol. 22, No. 7, Jul. 2004.
European Search Report issued in EP 13843836.1.
Chong, S., et al., "Utilizing The C-Terminal Cleavage Activity of a Protein Splicing Element to Purify Recombinant Proteins in a Single Chromatographic Step," Nucleic Acids Research, Oct. 1, 1998, vol. 26, pp. 5109-5115; p. 5111, col. 1, paragraph 1, col. 2, paragraph 1.
Apgar, J., et al., "A Predictive Model of Intein Insertion Site for Use in the Engineering of Molecular Switches," PLoS ONE, May 23, 2012, vol. 7, No. 5; e37355, DOI: 10.1371/journal.pone.0037355.
Bonifait et al., "The cell envelope subtilisin-like proteinase is a virulence determinant for *Streptococcus suis*", BMC Microbiology 2010, 10:42.
Davis et al., "The controlled introduction of multiple negative charge at single amino acid sites in subtilisin Bacillus lentus". Bioorg Med Chem 1999, 7:2293-2301.
Ishida et al., "High efficiency transformation of maize (*Zea mays* L.) mediated by Agrobacterium tumefaciens". (1996) Nature Biotech, 14(6), 745-750.
Negrotto et al., "The use of phosphomannose-isomerase as a selectable marker to recover transgenic maize plants (*Zea mays* L.) via Agrobacterium", Plant Cell Reports (2000) 19: 798-803.

(Continued)

*Primary Examiner* — Marsha Tsay
(74) *Attorney, Agent, or Firm* — Volpe and Koenig, P.C.

(57) ABSTRACT

Methods for expressing multiple proteins by constructing transformation vectors that include multiprotein expression cassettes and transforming hosts with vectors and by engineering hosts expressing multiprotein units are provided. Multiprotein units that include multiple proteins fused to modified inteins capable of effecting splicing of the multiprotein units are described. Expression cassettes that include nucleic acids encoding multiprotein units and hosts including the expression cassettes are also provided.

15 Claims, 17 Drawing Sheets

(56) References Cited

OTHER PUBLICATIONS

Vazquez et al., "Extracellular proteases from eight psychrotolerant antarctic strains" Microbiological Research (2004) 159:157-166.
Belfort and Roberts, "Homing endonucleases: keeping the house in order", Nucleic Acids Research, vol. 25, No. 17, pp. 3379-3388; 1997.
International Preliminary Report on Patentability of International Application No. PCT/US2013/063298.
Wang and Liu, "Identification of an Unusual Intein in Chloroplast ClpP Protease of Chlamydomonas eugametos" J. Biol. Chemistry, vol. 272, No. 18, Issue of May 2, pp. 11869-11873; 1997.
U.S. Office Action issued in U.S. Appl. No. 14/433,104.
Christiansen et al., 2003,"Production of Savinase and population viability of Bacillus clausii during high-cell-density fed-batch cultivations," Biotech. Bioeng., 83: 344-352.
Dassa et al., 2009, "Fractured genes, a novel genomic arrangement involving new split inteins and a new homing endonuclease family," Nucleic Acid Research, 37(8): 2560-2573.
Hadler-Olsen et al.., 2011, "Regulation of matrix metalloproteinase activity in health and disease," FEBS Journal, 278: 28-45.
Skretas et al., 2005, "Regulation of protein activity with small-molecule-controlled inteins," Plant Science, 14: 523-532.
Xu et al., 2012, "Green factory: plants as bioproduction platforms for recombinant proteins," Biotechnology Advances, 30: 1171-1184.
Genbank Accession No. AP006627.1, 2009, www.ncbi.nlm.nih.gov.
Uniprot, Accession No. P41362, 2011, www.uniprot.org.
U.S. Office Action dated Jun. 2, 2016 in U.S. Appl. No. 14/433,104.

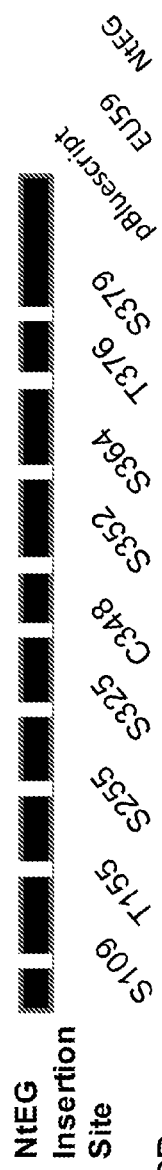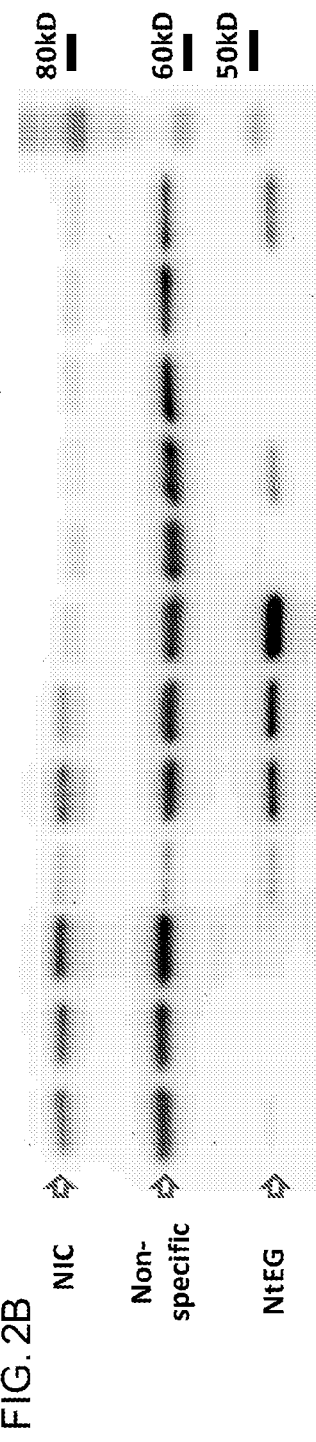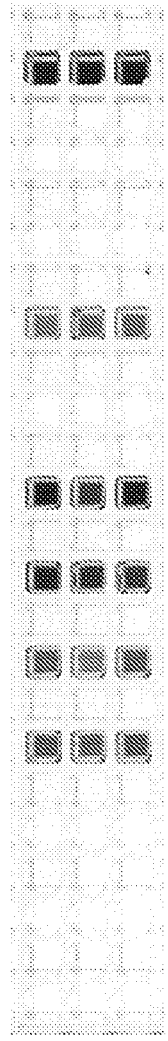
FIG. 2A
FIG. 2B
FIG. 2C

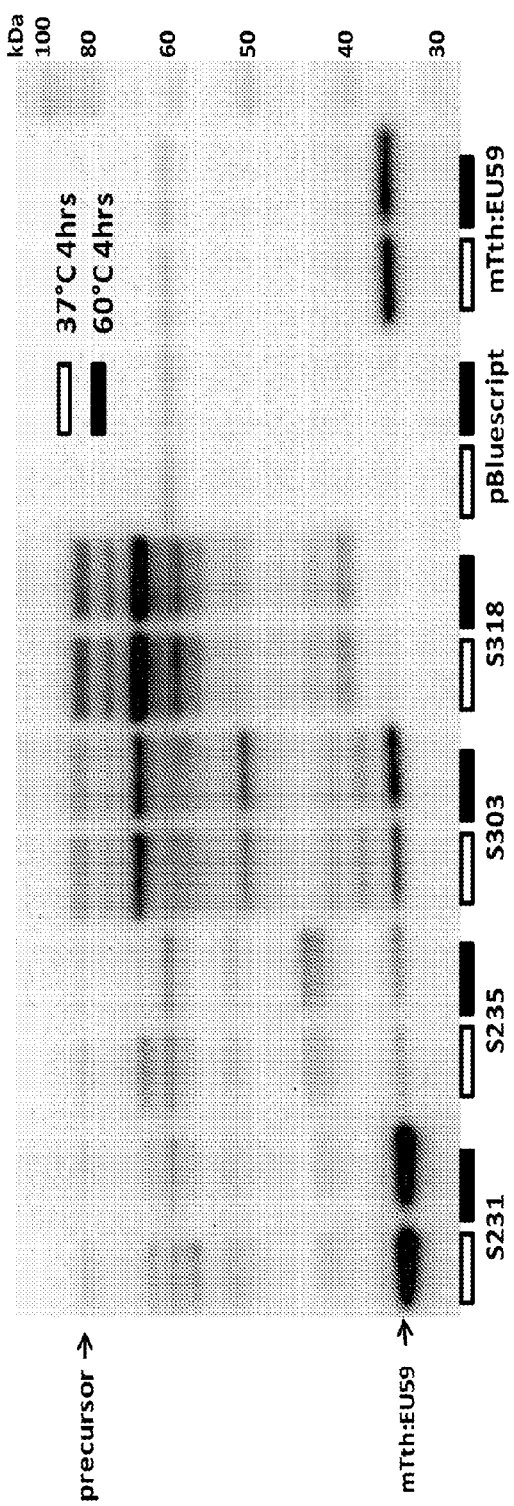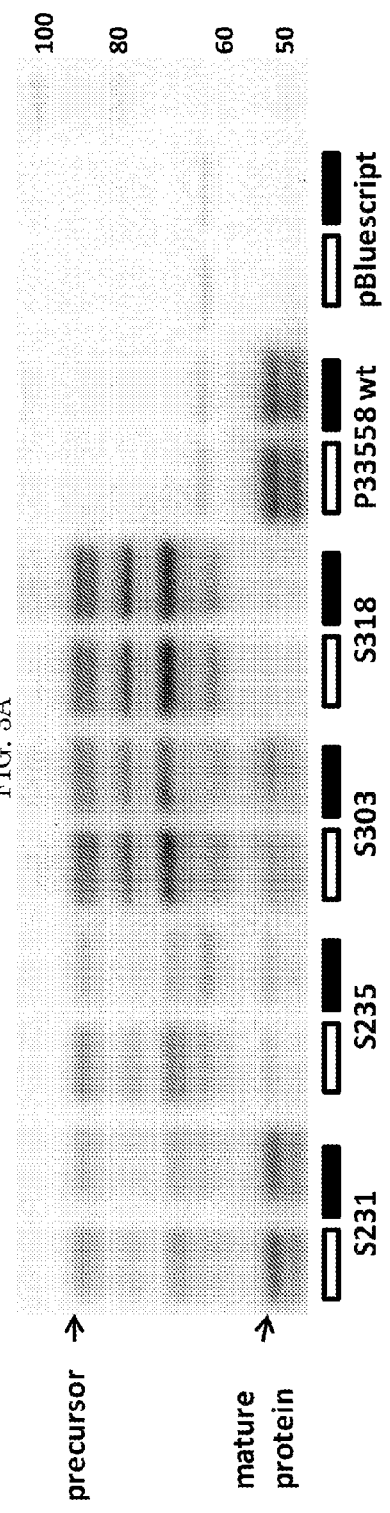
FIG. 3A
FIG. 3B

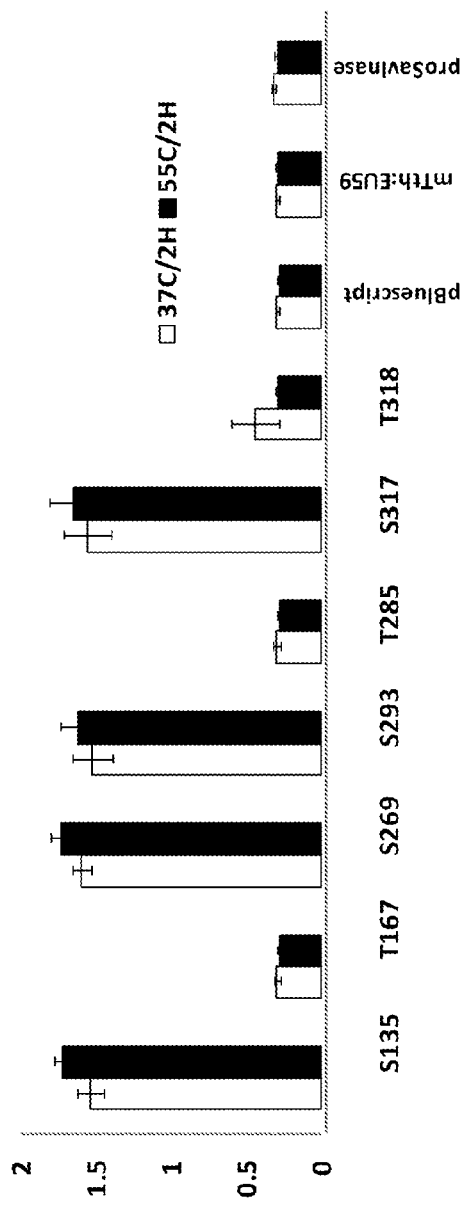
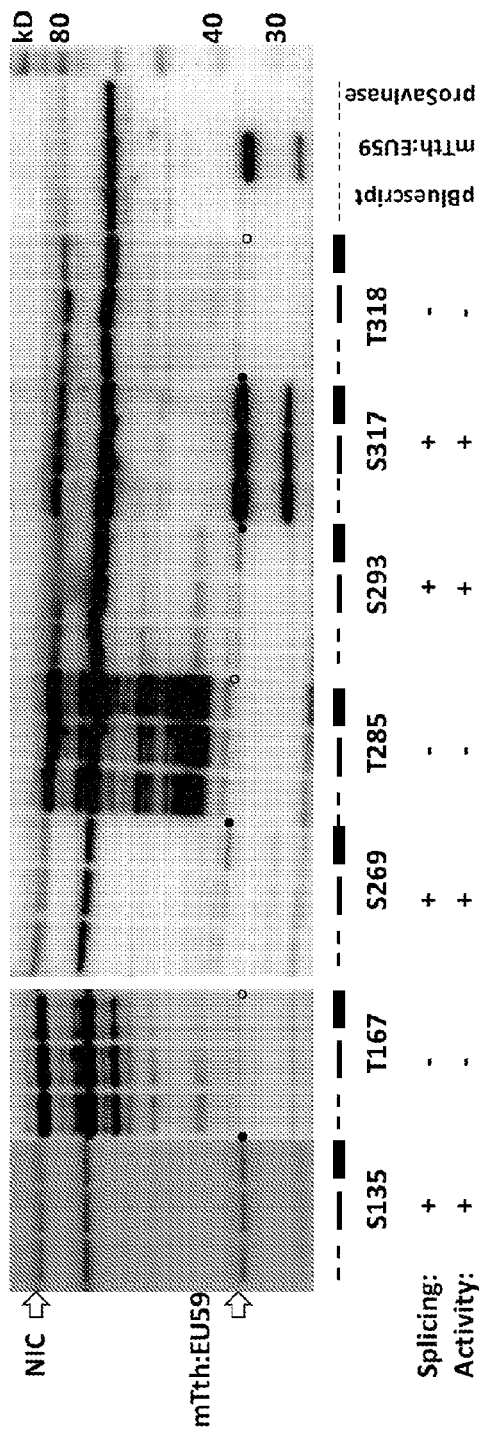
FIG. 14A
FIG. 14B

MULTIPROTEIN EXPRESSION CASSETTES

CROSS REFERENCE TO RELATED APPLICATIONS

This application is a 35 U.S.C. § 371 national phase application of PCT/US2013/063298, which was filed Oct. 3, 2013, and claims the benefit of U.S. provisional application No. 61/783,424, filed Mar. 14, 2013, and U.S. provisional application No. 61/744,863, filed Oct. 3, 2012, all of which are incorporated herein by reference as if fully set forth.

The sequence listing electronically filed with this application titled "Sequence Listing," which was created on Oct. 3, 2013 and had a size of 1,032,603 bytes is incorporated by reference herein as if fully set forth.

FIELD

The disclosure relates to expression cassettes for expressing multiple proteins, multiprotein units, methods for expressing multiple proteins by constructing transformation vectors including multiprotein expression cassettes and transforming hosts with vectors and by engineering host expressing multiprotein units. The disclosure also relates to transgenic hosts expressing multiple proteins.

BACKGROUND

Plant-based production of multiple proteins may be beneficial for many industrial, pharmaceutical and agricultural applications due to potential low production cost, ease of scale-up and abundant availability of plants. Methods of genetic engineering of plants to produce exogenous proteins are well established.

SUMMARY

In an aspect, the invention relates to a multiprotein unit comprising i) a modified intein including a first protein and an intein, and ii) a second protein. The first protein is fused internally to the intein. The modified intein is fused internally to the second protein. The modified intein is capable of effecting splicing of the multiprotein unit.

In an aspect, the invention relates to an expression cassette that includes a nucleic acid encoding a multiprotein unit. The multiprotein unit comprises i) a modified intein having a first protein and an intein, and ii) a second protein. The first protein is fused internally to the intein. The modified intein is fused internally to the second protein. The modified intein is capable of effecting splicing of the multiprotein unit.

In an aspect, the invention relates to a vector that includes any expression cassette described herein.

In an aspect, the invention relates to a host expressing a multiprotein unit. The multiprotein unit comprises i) a modified intein including a first protein and an intein, and ii) a second protein. The first protein is fused internally to the intein. The modified intein is fused internally to the second protein. The modified intein is capable of effecting splicing of the multiprotein unit.

In an aspect, the invention relates to a method for producing multiple proteins in a host. The method includes contacting a host cell with a transformation vector that includes the expression cassettes. The expression cassette includes a nucleic acid encoding any multiprotein unit described herein. The method includes selecting the host cell that includes the expression cassette. The method also includes culturing the host cell under conditions effective for expression of the multiprotein unit.

In an aspect, the invention relates to a method for regulating expression of at least one protein. The method includes allowing a modified intein in a multiprotein unit to splice the multiprotein unit. The multiprotein unit comprises i) a modified intein including a first protein and an intein, and ii) a second protein. The first protein is fused internally to the intein. The modified intein is fused internally to the second protein in such a position as to substantially reduce or inhibit the activity of the second protein. The modified intein is capable of effecting splicing of the multiprotein unit.

BRIEF DESCRIPTION OF THE DRAWINGS

The following detailed description of the embodiments of the present invention will be better understood when read in conjunction with the appended drawings. For the purpose of illustration, there are shown in the drawings embodiments which are presently preferred. It is understood, however, that the invention is not limited to the precise arrangements and instrumentalities shown. In the drawings:

FIG. 2A is a diagram that illustrates stacking multiple enzymes using the miniature Tth intein.

FIGS. 2B-2C illustrate cellulase activity of NtEG cellulase after splicing of the modified mTth:EU59 intein.

FIG. 3A illustrates mTth:EU59 splicing in xylanase P33558 analyzed by Western blot using the EU59-specific antibody.

FIG. 3B illustrates mTth:EU59 splicing in xylanase P33558 analyzed by Western blot using the P33-specific antibody.

FIG. 14A illustrates that intein splicing restores Savinase activity.

FIG. 14B illustrates Western blots of intein splicing in proSavinase.

DETAILED DESCRIPTION OF EMBODIMENTS

Figure 1:
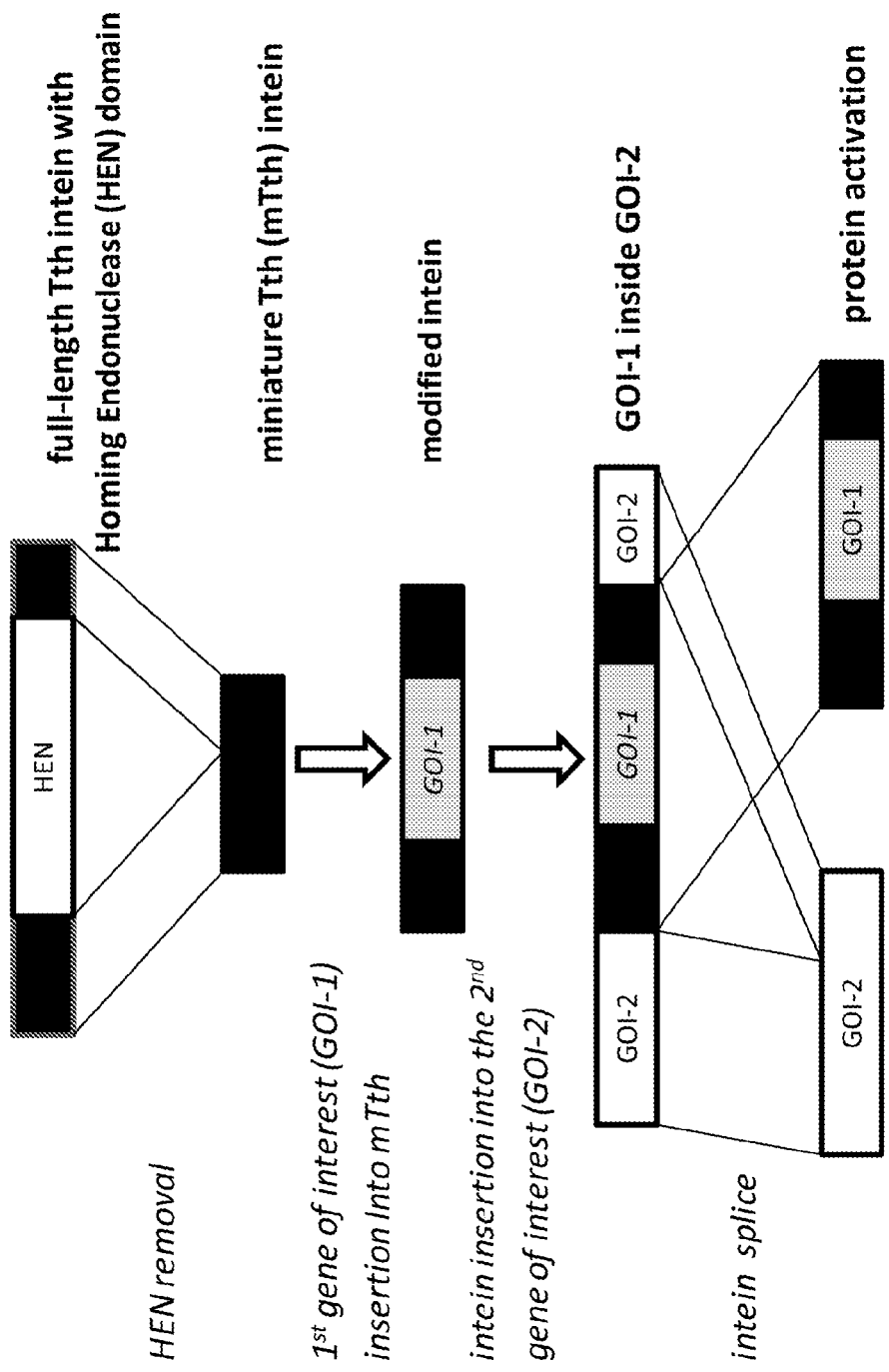
FIG. 1 illustrates a miniature Tth intein modified for enzyme stacking.

Certain terminology is used in the following description for convenience only and is not limiting. The words "right," "left," "top," and "bottom" designate directions in the drawings to which reference is made. The words "a" and "one," as used in the claims and in the corresponding portions of the specification, are defined as including one or more of the referenced item unless specifically stated otherwise. This terminology includes the words above specifically mentioned, derivatives thereof, and words of similar import. The phrase "at least one" followed by a list of two or more items, such as "A, B, or C," means any individual one of A, B or C as well as any combination thereof.

A genetic construct allowing the concerted expression of multiple genes using a single set of regulatory transcription elements, promoters and polyadenylation sequences, is desirable to avoid hurdles associated with introducing genes separately using multiple transformation or breeding steps often resulted in gene silencing. When expression of active proteins is harmful to a plant cell, it is also desirable to have a genetic construct that controls the expression and activity of the proteins.

An efficient system for producing multiple proteins from a single contiguously translated protein called a multiprotein unit is provided. The multiprotein unit may include a first protein, a second protein, and an intein. The first protein may be fused internally to the intein, and together the first protein internally fused to the intein referred to as a modified intein. The modified intein may be fused internally to the second protein and may be capable of effecting splicing of the multiprotein unit.

The first protein or the second protein of the multiprotein unit may be any protein. The first protein or the second protein may be an enzyme. The first protein or the second protein may be independently selected from but are not limited to a protease, a phytase, an amylase, an invertase, a xylanase, an endoglucanase, an exoglucanase, a feruloyl esterase, a lipase, and a cellulase. The protein selected as the first protein may differ from the protein selected as the second protein. The protein selected as the first protein may be the same as the protein selected as the second protein.

The intein may be any intein. Inteins are polypeptides that have the ability to cleave themselves from proteins post-translationally and may mediate ligation of the remaining protein fragments (the exteins) and may have the ability to cleave DNA at specific sites for their propagations. Engineered inteins may have the ability to cleave themselves but may lose their ability to cleave the DNA. The intein may be but is not limited to mTth, Pho_RadA, Tko_RadA, Sce_VMA, mVMA, Pab_Lon, and Hwa_MCM-1. Intein sequences that may be in a multiprotein unit herein may be found in InBase, the intein database Perler et al. 1992 Proc Natl Acad Sci USA 89: 5577), which is incorporated by reference herein as if fully set forth. A non-limiting list of inteins that may be used to create or be part of a multiprotein unit herein are listed as follows: APMVPol (*Acanthomoeba polyphaga* Mimivirus), AbrPRP8 (*Aspergillus brevipes* FRR2439), Aca-JER2004PRP8 (*Ajellomyces capsulatus*), Aca-H143PRP8 (*Ajellomyces capsulatus* H143), Ade-ER3PRP8 (*Ajellomyces dermatitidis* ER-3), Aca-NAm1PRP8 (*Ajellomyces capsulatus* NAm1), Afu-Af293PRP8 (*Aspergillus fumigatus* var. *ellipticus* strain Af293), Ade-SLH14081PRP8 (*Ajellomyces dermatitidis* SLH14081), Afu-FRR0163PRP8 (*Aspergillus fumigatus* strain FRR0163), Afu-NRRL5109PRP8 (*Aspergillus fumigatus* var. *ellipticus* strain NRRL 5109), Ani-FGSCA4PRP8 (*Aspergillus nidulans* FGSC A), Agi-NRRL6136PRP8 (*Aspergillus giganteus* Strain NRRL 6136), AviPRP8 (*Aspergillus viridinutans* strain FRR0577), BciPRP8 (*Botrytis cinerea*), Bde-JEL423PRP8-1 (*Batrachochytrium dendrobatidis* JEL423), Bde-JEL197RPB2 (*Batrachochytrium dendrobatidis* JEL197), Bde-JEL423eIF-5B (*Batrachochytrium dendrobatidis* JEL423), Bde-JEL423PRP8-2 (*Batrachochytrium dendrobatidis* JEL423), Bfu-B05PRP8 (*Botryotinia fuceliana* B05.10), Bde-JEL423RPC2 (*Batrachochytrium dendrobatidis* JEL423), CIVRIR1 (*Chilo iridescent* virus), CV-NY2AORF212392 (*Chlorella* virus NY2A), CV-NY2ARIR1 (*Chlorella* virus NY2A), CZIVRIR1 (*Costelytra zealandica* iridescent virus), Cba-WM02.98PRP8 (*Cryptococcus bacillisporus* strain WM02.98), Cba-WM728PRP8 (*Cryptococcus bacillisporus* strain WM728), CeuClpP (*Chlamydomonas eugametos*), CgaPRP8 (*Cryptococcus gattii*), ClaPRP8 (*Cryptococcus laurentii* strain CBS139), CmoClpP (*Chlamydomonas moewusii* strain UTEX 97), CmoRPB2 (*Chlamydomonas moewusii* strain UTEX 97), CglVMA (*Candida glabrata*), CpaThrRS (*Candida parapsilosis* strain CLIB214), Fne-APRP8 (*Filobasidiella neoformans* Serotype A), Cne-JEC21PRP8 (*Cryptococcus neoformans* JEC21), Fne-AD-PRP8 (*Cryptococcus neoformans* Serotype AD), CreRPB2 (*Chlamydomonas reinhardtii*), CroVRPB2 (*Cafeteria roenbergensis* virus BV-PW1), CroVRIR1 (*Cafeteria roenbergensis* virus BV-PW1), CroVPol (*Cafeteria roenbergensis* virus BV-PW1), CroVTop2 (*Cafeteria roenbergensis* virus BV-PW1), CtrThrRS (*Candida tropicalis* ATCC750), CstRPB2 (*Coelomomyces stegomyiae*), CtrVMA (*Candida tropicalis*), DdiRPC2 (*Dictyostelium discoideum* strain AX4), DhanVMA (*Debaryomyces hansenii* CBS767), Ctr-MYA3404VMA (*Candida tropicalis* MYA-3404), DhanGLT1 (*Debaryomyces hansenii* CBS767), FteRPB2 (*Floydiella terrestris* strain UTEX 1709), GthDnaB (*Guillardia theta*), EniPRP8 (*Emericella nidulans* R20), Eni-FCSGA4PRP8 (*Emericella nidulans* FGSC A4), HaVOlPol (*Heterosigma akashiwo* virus 01), HcaPRP8 (*Histoplasma capsulatum*), IIV6RIR1 (Invertebrate iridescent virus 6), Kex-CBS379VMA (*Kazachstania exigua* strain CBS379), Kla-CBS683VMA (*Kluyveromyces lactis* strain CBS683), Kla-IFO1267VMA (*Kluyveromyces lactis* IFO1267), Kla-NRRLY1140VMA (*Kluyveromyces lactis* NRRL Y-1140), LelVMA (*Lodderomyces elongisporus*), NauPRP8 (*Neosartorya aurata* NRRL 4378), Mca-CBS113480PRP8 (*Microsporum canis* CBS 113480), NfiPRP8 (*Neosartorya fischeri*), Nfe-NRRL5534PRP8 (*Neosartorya fennelliae* NRRL 5534), Ngl-FRR1833PRP8 (*Neosartorya glabra* FRR1833), Ngl-FR2163PRP8 (*Neosartorya glabra* FRR2163), NquPRP8 (*Neosartorya quadricincta* strain NRRL 4175), NspiPRP8 (*Neosartorya spinosa* FRR4595), Pabr-Pb01PRP8 (*Paracoccidioides brasiliensis* Pb01), Pabr-Pb03PRP8 (*Paracoccidioides brasiliensis* Pb03), Pan- GLT1 (*Podospora anserina*), PanCHS2 (*Podospora anserina*), PchPRP8 (*Penicillium chrysogenum*), Pb1PRP8-a (*Phycomyces blakesleeanus*), Pbr-Pb18PRP8 (*Paracoccidioides brasiliensis* Pb18), Pb1PRP8-b (*Phycomyces blakesleeanus*), PexPRP8 (*Penicillium expansum*), PguGLT1 (*Pichia guilliermondii*), PnoGLT1 (Phaeosphaeria nodorum SN15), Pgu-altGLT1 (*Pichia guilliermondii*), Pst-VMA (*Pichia stipitis* CBS 6054), PnoRPA2 (*Phaeosphaeria nodorum* SN15), PpuDnaB (*Porphyra purpurea*), PtrPRP8 (*Pyrenophora tritici*-repentis Pt-1C-BF), PvuPRP8 (*Penicillium vulpinum*), PyeDnaB (*Porphyra yezoensis*), Sca-CBS4309VMA (*Saccharomyces castellii* strain CBS4309), SasRPB2 (*Spiromyces aspiralis* NRRL 22631), SceVMA, VMA (*Saccharomyces cerevisiae*), Sca-IFO1992VMA (*Saccharomyces* castellii strain IFO1992), Sce-DH1-1AVMA (*Saccharomyces cerevisiae* strain DH1-1A), ScarVMA (*Saccharomyces cariocanus* strain UFRJ 50791), Sce-Jay291VMA (*Saccharomyces cerevisiae* JAY291), Sce-YJM789VMA (*Saccharomyces cerevisiae* strain YJM789), Sce-OUT7091VMA (*Saccharomyces cerevisiae* OUT7091), Sce-OUT7112VMA (*Saccharomyces cerevisiae* OUT7112), SjaVMA (*Schizosaccharomyces japonicus* yFS275), Sex-IFO1128VMA (*Saccharomyces exiguus* strain IFO1128), SheRPB2 (*Stigeoclonium helveticum* strain UTEX 441), SdaVMA (*Saccharomyces dairenensis* strain CBS 421), SpaVMA (*Saccharomyces pastorianus* IFO11023), Spu-PRP8 (*Spizellomyces punctatus*), SunVMA (*Saccharomyces unisporus* strain CBS 398), TglVMA (*Torulaspora globosa* strain CBS 764), TprVMA (*Torulaspora pretoriensis* strain CBS 5080), Ure-1704PRP8 (*Uncinocarpus reesii*), VpoVMA (*Vanderwaltozyma polyspora* strain CBS 2163), WIVRIR1 (*Wiseana iridescent virus*), ZroVMA (*Zygosaccharomyces rouxii* strain CBS 688), ZbiVMA (*Zygosaccharomyces bisporus* strain CBS 702), ZbaVMA (*Zygosaccharomyces bailii* strain CBS 685), AP-APSE1dpol (*Acyrthosiphon pisum* secondary endosymbiot phage 1), AP-APSE2dpol (Bacteriophage APSE-2), AP-APSE4dpol (*Candidatus Hamiltonella defensa* strain 5ATac bacteriophage), AP-APSE5dpol (Bacteriophage APSE-5), AP-Aaphi23MupF (Bacteriophage Aaphi23), AaeRIR2 (*Aquifex aeolicus* strain VF5), Aave-AAC001RIR1 (*Acidovorax avenae* subsp. *citrulli* AAC00-1), Aave-AAC001Aave1721 (*Acidovorax avenae* subsp. *citrulli* AAC00-1), Aave-ATCC19860RIR1 (*Acidovorax avenae* subsp. *avenae* ATCC 19860), AbaHyp-02185 (*Acinetobacter baumannii* ACICU), AceRIR1 (*Acidothermus cellulolyticus* 11B), AehDnaB-1 (*Alkalilimnicola ehrlichei* MLHE-1), AehDnaB-2 (*Alkalilimnicola ehrlichei* MLHE-1), AehRir1 (*Alkalilimnicola ehrlichei* MLHE-1), MupF-MupF (Aggregatibacter phage S1249), AhaDnaE-c (*Aphanothece halophytica*), AhaDnaE-n (*Aphanothece halophytica*), Alvi-DSM180GyrA (*Allochromatium vinosum* DSM 180), AmaMADE823 (*Alteromonas macleodii*), Amax-CS328DnaX (*Arthrospira maxima* CS-328), AovDnaE-c (*Aphanizomenon ovalisporum*), AovDnaE-n (*Aphanizomenon ovalisporum*), Apl-C1DnaX (*Arthrospira platensis*), AspDnaE-c (*Anabaena* species PCC7120), Arsp-FB24DnaB (*Arthrobacter* species FB24), AspDnaE-n (*Anabaena* species PCC7120), AvaDnaE-c (*Anabaena variabilis* ATCC29413), AvinRIR1BIL (*Azotobacter vinelandii*), AvaDnaE-n (*Anabaena variabilis* ATCC29413), Bce-MCO3DnaB (*Burkholderia cenocepacia* MCO-3), Bce-PC184DnaB (*Burkholderia cenocepacia* PC184), Bse-MLS10TerA (*Bacillus selenitireducens* MLS10), BsuP-M1918RIR1 (*B. subtilis* M1918 prophage), BsuP-SPBc2RIR1 (*B. subtilis* strain 168 Sp beta c2 prophage), Bcep1808_7358 (*Burkholderia vietnamiensis* G4), CP-P1201Thy1 (*Corynebacterium* phage P1201), CagRIR1 (*Chlorochromatium aggregatum*), CauSpoVR (*Chloroflexus aurantiacus* J-10-fl), CbP-C-StRNR (*Clostridium botulinum* phage C-St), CbP-D1873RNR (*Clostridium botulinum* phage D), Cbu-DugwayDnaB (*Coxiella burnetii* Dugway 5J108-111), Cbu-GoatDnaB (*Coxiella burnetii* MSU Goat Q177), Cbu-RSA334DnaB (*Coxiella burnetii* RSA 334), Cbu-RSA493DnaB (*Coxiella burnetii* RSA 493), CceHyp1-Csp-2 (*Cyanothece* sp. ATCC 51142), CchRIR1 (*Chlorobium chlorochromatii* CaD3), CcyHyp 1-Csp-1 (*Cyanothece* sp. CCY0110), CcyHyp1-Csp-2 (*Cyanothece* sp. CCY0110), Cfl-DSM20109DnaB (*Cellulomonas flavigena* DSM 20109), ChyRIR1 (*Carboxydothermus hydrogenoformans* Z-2901), CklPTerm (*Clostridium kluyveri* DSM 555), Cra-CS505DnaE-c (*Cylindrospermopsis raciborskii* CS-505), Cra-CS505DnaE-n (*Cylindrospermopsis raciborskii* CS-505), Cra-CS505GyrB (*Cylindrospermopsis raciborskii* CS-505), Csp-CCY0110DnaE-c (*Cyanothece* sp. CCY0110), Csp-CCY0110DnaE-n (*Cyanothece* sp. CCY0110), Csp-PCC7424DnaE-c (*Cyanothece* sp. PCC 7424), Csp-PCC7424DnaE-n (*Cyanothece* sp. PCC7424), Csp-PCC7425DnaB (*Cyanothece* sp. PCC 7425), Csp-PCC7822DnaE-n (*Cyanothece* sp. PCC 7822), Csp-PCC8801DnaE-c (*Cyanothece* sp. PCC 8801), Csp-PCC8801DnaE-n (*Cyanothece* sp. PCC 8801), CthATPaseBIL (*Clostridium thermocellum*), Cth-ATCC27405TerA (*Clostridium thermocellum* ATCC27405), Cth-DSM2360TerA (*Clostridium thermocellum* DSM 2360), CwaDnaB (*Crocosphaera watsonii* WH 8501), CwaDnaE-c (*Crocosphaera watsonii* WH 8501), CwaDnaE-n (*Crocosphaera watsonii* WH 8501), CwaPEP (*Crocosphaera watsonii* WH 8501), CwaRIR1 (*Crocosphaera watsonii* WH 8501), DaudRIR1 (*Camlidatus Desulformlis audaxviator* MP104C), DgeDnaB (*Deinococcus geothermalis* DSM11300), Dha-DCB2RIR1 (*Desulfitobacterium hafniense* DCB-2), Dha-Y51RIR1 (*Desulfitobacterium hafniense* Y51), Dpr-MLMS1RIR1 (delta proteobacterium MLMS-1), DraRIR1 (*Deinococcus radiodurans* R1 TIGR strain), DraSnf2-c (*Deinococcus radiodurans* R1 TIGR strain), Snf2-nN-TERM (*Deinococcus radiodurans* R1 TIGR strain), Dra-ATCC13939Snf2 (*Deinococcus radiodurans* R1 ATCC13939 Brooks & Murray strain), UDPGD (*Dictyoglomus thermophilum* 11-6-12), DvulParB (*Desulfovibrio vulgaris* subsp. *vulgaris* DP4), EP-Min27Primase (Enterobacteria phage Min27), FalDnaB (*Frankia alni* ACN14a), Fsp-CcI3RIR1 (*Frankia* species CcI3), GobDnaE (*Gemmata obscuriglobus* UQM2246), GobHyp (*Gemmata obscuriglobus* UQM2246), GviDnaB (*Gloeobacter violaceus* PCC 7421), GviRIR1-2 (*Gloeobacter violaceus* PCC 7421), GviRIR1-1 (*Gloeobacter violaceus* PCC 7421), HhalDnaB (*Halorhodospira halophila* SL1), Kfl-DSM17836DnaB (*Kribbella flavida* DSM 17836), KraDnaB (*Kineococcus radiotolerans* SRS30216), LLP-KSY1PolA (*Lactococcus* phage KSY1), LP-phiHSIChelicase (*Listonella pelagia* phage phiHSIC), Lsp-PCC8106GyrB (*Lyngbya* sp. PCC 8106), MP-BeDnaB (Mycobacteriophage Bethlehem), MP-Begp51 (Mycobacteriophage Bethlehem), MP-Cateragp206 (Mycobacteriophage Catera), MP-KB-Ggp53 (*Mycobacterium* phage KBG), MP-OmegaDnaB (Mycobacteriophage Omega), MP-Mcjw1DnaB (Mycobacteriophage CJW1), gp50 (Mycobacteriophage U2), Maer-NIES843DnaB (*Microcystis aeruginosa* NIES-843), Maer-NIES843DnaE-c (*Microcystis aeruginosa* NIES-843), Maer-NIES843DnaE-n (*Microcystis aeruginosa* NIES-843), Mau-ATCC27029GyrA (*Micromonospora aurantiaca* ATCC 27029), Mav-104DnaB (*Mycobacterium avium* 104), Mav-ATCC25291DnaB (*Mycobacterium avium* subsp.

avium ATCC 25291), Mav-ATCC35712DnaB (*Mycobacterium avium*), Mav-PTDnaB (*Mycobacterium avium* subsp. *paratuberculosis* str. k10), MboPps1 (*Mycobacterium bovis* subsp. *bovis* AF2122/97), MboRecA (*Mycobacterium bovis* subsp. *bovis* AF2122/97), MboPps1 (*Mycobacterium bovis* subsp. *bovis* AF2122/97), Mbo-AF2122DnaB (*Mycobacterium bovis* subsp. *bovis* AF2122/97), Mbo-1173PDnaB (*Mycobacterium bovis* BCG Pasteur 1173P), McaMupF (*Methylococcus capsulatus* Bath prophage MuMc02), McaRIR1 (*Methylococcus capsulatus* Bath), MchRecA (*Mycobacterium chitae*), Mcht-PCC7420DnaE-1 (*Microcoleus chthonoplastes* PCC7420), Mcht-PCC7420DnaE-2c (*Microcoleus chthonoplastes* PCC7420), Mcht-PCC7420DnaE-2n (*Microcoleus chthonoplastes* PCC7420), Mcht-PCC7420GyrB (*Microcoleus chthonoplastes* PCC7420), Mcht-PCC7420RIR1-1 (*Microcoleus chthonoplastes* PCC7420), Mcht-PCC7420RIR1-2 (*Microcoleus chthonoplastes* PCC7420), Mexhelicase (*Methylobacterium extorquens* AM1), MexTrbC (*Methylobacterium extorquens* AM1), MfaRecA (*Mycobacterium fallax*), MflGyrA (*Mycobacterium flavescens* Fla0), MflRecA (*Mycobacterium flavescens* Fla0), Mfl-ATCC14474RecA (*Mycobacterium flavescens* ATCC14474), Mfl-PYR-GCKDnaB (*Mycobacterium flavescens* PYR-GCK), MgaGyrA (*Mycobacterium gastri*), MgaRecA (*Mycobacterium gastri*), MgaPps1 (*Mycobacterium gastri*), Mgi-PYR-GCKDnaB (*Mycobacterium gilvum* PYR-GCK), Mgi-PYR-GCKGyrA (*Mycobacterium gilvum* PYR-GCK), MgoGyrA *Mycobacterium gordonae*), Min-1442DnaB *Mycobacterium intracellulare*), Min-ATCC 13950 GyrA (*Mycobacterium intracellulare* ATC C 13950), MkasGyrA (*Mycobacterium kansasii*), Mkas-ATC C 12478 GyrA (*Mycobacterium kansasii* ATCC 12478), Mle-Br4923GyrA *Mycobacterium leprae* Br4923), Mle-TNDnaB *Mycobacterium leprae* strain TN), Mle-TNGyrA *Mycobacterium leprae* TN), MlePps1 (*Mycobacterium leprae*), Mle-TNRecA (*Mycobacterium leprae* strain TN), MmaGyrA (*Mycobacterium malmoense*), MmagMagn8951BIL (*Magnetospirillum magnetotacticum* MS-1), MshRecA *Mycobacterium shimodei*), MsmDnaB-1 (*Mycobacterium smegmatis* MC2 155), MsmDnaB-2 (*Mycobacterium smegmatis* MC2 155), Msp-KMSDnaB *Mycobacterium* species KMS), Msp_KMSGyrA *Mycobacterium* species KMS), Msp-MCSDnaB *Mycobacterium* species MCS), Msp_MCSGyrA (*Mycobacterium* species MCS), MtheRecA (*Mycobacterium thermoresistibile*), MtuPps1 (*Mycobacterium tuberculosis* strain H37Rv), Mtu-CDC1551DnaB *Mycobacterium tuberculosis* CDC1551), Mtu-CRecA (*Mycobacterium tuberculosis* C), Mtu-CPHL-RecA (*Mycobacterium tuberculosis* CPHL_A), Mtu-EAS054RecA *Mycobacterium tuberculosis* EAS054), Mtu-CanettiRecA (*Mycobacterium tuberculosis* strain Canetti), Mtu-F 11DnaB *Mycobacterium tuberculosis* strain F11), Mtu-H37RaDnaB (*Mycobacterium tuberculosis* 1137Ra), Mtu-1137RvDnaB (*Mycobacterium tuberculosis* 1137Rv), Mtu-H37RvRecA *Mycobacterium tuberculosis* H37Rv, Also CDC 1551), Mtu-HaarlemDnaB *Mycobacterium tuberculosis* str. Haarlem), Mtu-R604RecA-n (*Mycobacterium tuberculosis* 98-R604 INH-RIF-EM), Mtu-K85RecA (*Mycobacterium tuberculosis* K85), Mtu-So93RecA (*Mycobacterium tuberculosis* So93/sub_species Canetti), Mtu-T17RecA-c *Mycobacterium tuberculosis* T17), Mtu-T17RecA-n (*Mycobacterium tuberculosis* T17), Mtu-T46RecA (*Mycobacterium tuberculosis* T46), Mtu-T85RecA (*Mycobacterium tuberculosis* T85), MvanDnaB (*Mycobacterium vanbaalenii* PYR-1), Mtu-T92RecA (*Mycobacterium tuberculosis* T92), MvanGyrA (*Mycobacterium vanbaalenii* PYR-1), MxaRAD25 (*Myxococcus xanthus* DK1622), MxeGyrA (*Mycobacterium xenopi* strain IMM5024), Naz-0708RIR1-2 (*Nostoc azollae* 0708), Naz-0708RIR1-1 (*Nostoc azollae* 0708), NfaDnaB (*Nocardia farcinica* IFM 10152), NfaNfa15250 (*Nocardia farcinica* IFM 10152), NfaRIR1 (*Nocardia farcinica* IFM 10152), Nosp-CCY9414DnaE-n (*Nodularia spumigena* CCY9414), NpuDnaB (*Nostoc punctiforme*), NpuGyrB (*Nostoc punctiforme*), Npu-PCC73102DnaE-c (*Nostoc punctiforme* PCC73102), Npu-PCC73102DnaE-n (*Nostoc punctiforme* PCC73102), Nsp-JS614DnaB (*Nocardioides* species JS614), Nsp-JS614TOPRIM (*Nocardioides* species JS614), Nsp-PCC7120DnaB (*Nostoc* species PCC7120), Nsp-PCC7120DnaE-c (*Nostoc* species PCC7120), Nsp-PCC7120DnaE-n (*Nostoc* species PCC7120), Nsp-PCC7120RIR1 (*Nostoc* species PCC7120), OliDnaE-c (*Oscillatoria limnetica* str. Solar Lake), OliDnaE-n (*Oscillatoria limnetica* str. Solar Lake), PP-PhiELHelicase (*Pseudomonas aeruginosa* phage phiEL), PP-PhiELORF11 (*Pseudomonas aeruginosa* phage phiEL), PP-PhiELORF40 (*Pseudomonas aeruginosa* phage phiEL), PP-PhiELORF39 (*Pseudomonas aeruginosa* phage phiEL), PflFhaBIL (*Pseudomonas fluorescens* Pf-5), Pma-ExH1DnaE (*Persephonella marina* EX-H1), PlutRIR1 (*Pelodictyon luteolum* DSM 273), Pma-EXH1GyrA (*Persephonella marina* EX-H1), PnaRIR1 (*Polaromonas naphthalenivorans* CJ2), Posp-JS666DnaB (*Polaromonas* species JS666), PuncDnaB (*Polynucleobacter* sp. QLW-P1DMWA-1), Posp-JS666RIR1 (*Polaromonas* species JS666), Pssp-A1-1Fha (*Pseudomonas* species A1-1), PsyFha (*Pseudomonas syringae* pv. tomato str. DC3000), Rbr-D9GyrB (*Raphidiopsis brookii* D9), RceRIR1 (*Rhodospirillum centenum* SW), Rer-SK121DnaB (*Rhodococcus erythropolis* SK121), Rma-DnaB (*Rhodothermus marinus*), Rma-DSM4252DnaE (*Rhodothermus marinus* DSM 4252), Rma-DSM4252DnaB (*Rhodothermus marinus* DSM 4252), RspRirl (*Roseovarius* species 217), SaP-SETP12dpol (*Salmonella* phage SETP12), SaP-SETP3Helicase (*Salmonella* phage SETP3), SaP-SETP3dpol (*Salmonella* phage SETP3), SaP-SETP5dpol (*Salmonella* phage SETP5), SareDnaB (*Salinispora arenicola* CNS-205), ReGHelicase (*Streptomyces avermitilis* MA-4680), Sel-PC6301RIR1 (*Synechococcus elongatus* PCC 6301), Sel-PC7942DnaE-c (*Synechococcus elongatus* PC7942), Sel-PC7942RIR1 (*Synechococcus elongatus* PC7942), Sel-PC7942DnaE-n (*Synechococcus elongatus* PC7942), Sel-PCC6301DnaE-n (*Synechococcus elongatus* PCC 6301), Sel-PCC6301DnaE-c (*Synechococcus elongatus* PCC 6301 and PCC7942), ShP-Sfv-2a-2457T-nPrimase (*Shigella flexneri* 2a str. 2457T), SepRIRI (*Staphylococcus epidermidis* RP62A), ShP-Sfv-2a-301Primase (*Shigella flexneri* 2a str. 301), ShP-Sfv-5Primase (*Shigella flexneri* 5 str. 8401), SoP-SOldpol (*Sodalis* phage SO-1), SruDnaB (*Salinibacter ruber* DSM 13855), SplDnaX (*Spirulina platensis* strain C1), SruPolBc (*Salinibacter ruber* DSM 13855), SruRIR1 (*Salinibacter ruber* DSM 13855), SspDnaB (*Synechocystis* species strain PCC6803), SspDnaE-n, DnaE-N (*Synechocystis* species strain PCC6803), SspDnaE-c, DnaE-C (*Synechocystis* species strain PCC6803), SspDnaX (*Synechocystis* species strain PCC6803), Ssp-JA2RIR1 (*Synechococcus* species JA-2-3B a 2-13), Ssp-JA2DnaB (*Synechococcus* species JA-2-3B a 2-13), SspGyrB (*Synechocystis* species strain PCC6803), Ssp-JA3DnaB (*Synechococcus* species JA-3-3Ab), Ssp-JA3RIR1 (*Synechococcus* species JA-3-3Ab), Ssp-PCC7002DnaE-c (*Synechocystis* species strain PCC 7002), Ssp-PCC7002DnaE-n (*Synechocystis* species strain PCC 7002), Ssp-PCC7335RIR1 (*Synechococcus* sp. PCC 7335), StP-TwortORF6 (*Staphylococcus* phage Twort), Susp- NBC371DnaB (*Sulfurovum* sp. NBC37-1), Taq-Y51MC23DnaE (*Thermus aquaticus* Y51MC23), TelDnaE-c (*Thermosynechococcus elongatus* BP-1), TcuDSM43183RecA (*Thermomonospora curvata* DSM 43183), TelDnaE-n (*Thermosynechococcus elongatus* BP-1), Taq-Y51MC23RIR1 (*Thermus aquaticus* Y51MC23), TerDnaB-1 (*Trichodesmium erythraeum* IMS101), TerDnaB-2 (*Trichodesmium erythraeum* IMS101), TerDnaE-2 (*Trichodesmium erythraeum* IMS101), TerDnaE-1 (*Trichodesmium erythraeum* IMS101), TerDnaE-3c (*Trichodesmium erythraeum* IMS101), TerDnaE-3n (*Trichodesmium erythraeum* IMS101), TerGyrB (*Trichodesmium erythraeum* IMS101), TerNdse-1 (*Trichodesmium erythraeum* IMS101), TerNdse-2 (*Trichodesmium erythraeum* IMS101), TerRIR-1 (*Trichodesmium erythraeum* IMS101), TerRIR-2 (*Trichodesmium erythraeum* IMS101), TerRIR-3 (*Trichodesmium erythraeum* IMS101), TerRIR-4 (*Trichodesmium erythraeum* IMS101), TerSnf2 (*Trichodesmium erythraeum* IMS101), TerThyX (*Trichodesmium erythraeum* IMS101), TfusRecA-1 (*Thermobifida fusca* YX), TfusRecA-2 (*Thermobifida fusca* YX), TfusTfu2914 (*Thermobifida fusca* YX), Thsp-K90RIR1 (*Thioalkalivibrio* sp. K90mix), Tth-DSM571RIR1 (*Thermoanaerobacterium thermosaccharolyticum* DSM 571), Tth-HB27DnaE-1, Tth (*Thermus thermophilus* EIB27), Tth-HB27DnaE-2 (*Thermus thermophilus* EIB27), Tth-HB27RIR1-1 (*Thermus thermophilus* EIB27), Tth-HB27RIR1-2 (*Thermus thermophilus* EIB27), Tth-HB8DnaE-1 (*Thermus thermophilus* HB8), Tth-HB8DnaE-2 (*Thermus thermophilus* HB8), Tth-HB8RIR1-1 (*Thermus thermophilus* HB8), Tth-HB8RIR1-2 (*Thermus thermophilus* HB8), TvuDnaE-c (*Thermosynechococcus vulcanus*), TvuDnaE-n (*Thermosynechococcus vulcanus*), TyeRNR-1 (*Thermodesulfovibrio yellowstonii* DSM 11347), TyeRNR-2 (*Thermodesulfovibrio yellowstonii* DSM 11347), ApeAPE0745 (*Aeropyrum pernix* K1), CmebooPol-II (*Candidatus Methanoregula boonei* 6A8), Fac-Fer1RIR1 (*Ferroplasma acidarmanus* taxon:97393), FacPps1 (*Ferroplasma acidarmanus*), Fac-TypeIRIR1 (*Ferroplasma acidarmanus* type I), FacPps1 (*Ferroplasma acidarmanus*), HmaCDC21 (*Haloarcula marismortui* ATCC 43049), HmaPol-II (*Haloarcula marismortui* ATCC 43049), HmaPolB (*Haloarcula marismortui* ATCC 43049), HmaTopA (*Haloarcula marismortui* ATCC 43049), Hmu-DSM12286MCM (*Halomicrobium mukohataei* DSM 12286), Hmu-DSM12286PolB (*Halomicrobium mukohataei* DSM 12286), Hsa-R1MCM (*Halobacterium salinarum* R-1), Hsp-NRC1CDC21 (*Halobacterium* species NRC-1), Hsp-NRC1Pol-II (*Halobacterium salinarum* NRC-1), Hut-MCM-2 (*Halorhabdus utahensis* DSM 12940), HutMCM-1 (*Halorhabdus utahensis* DSM 12940), HwaGyrB (*Haloquadratum walsbyi* DSM 16790), HvoPolB (*Haloferax volcanii* DS70), HwaMCM-1 (*Haloquadratum walsbyi* DSM 16790), HwaMCM-2 (*Haloquadratum walsbyi* DSM 16790), HwaMCM-3 (*Haloquadratum walsbyi* DSM 16790), HwaMCM-4 (*Haloquadratum walsbyi* DSM 16790), HwaPol-II-1 (*Haloquadratum walsbyi* DSM 16790), HwaPol-II-2 (*Haloquadratum walsbyi* DSM 16790), HwaPolB-1 (*Haloquadratum walsbyi* DSM 16790), HwaPolB-2 (*Haloquadratum walsbyi* DSM 16790), HwaPolB-3 (*Haloquadratum walsbyi* DSM 16790), HwaRCF (*Haloquadratum walsbyi* DSM 16790), HwaRIR1-1 (*Haloquadratum walsbyi* DSM 16790), HwaRIR1-2 (*Haloquadratum walsbyi* DSM 16790), HwaTop6B (*Haloquadratum walsbyi* DSM 16790), rPo1A" (*Haloquadratum walsbyi* DSM 16790), MaeoPol-II (*Methanococcus aeolicus* Nankai-3), MaeoRFC (*Methanococcus aeolicus* Nankai-3), MaeoRNR (*Methanococcus aeolicus* Nankai-3), Maeo-N3Helicase (*Methanococcus aeolicus* Nankai-3), UDPGD (*Methanococcus aeolicus* Nankai-3), Maeo-N3RtcB (*Methanococcus aeolicus* Nankai-3), MeinMEPEP (*Methanocaldococcus infernus* ME), MeinMERFC (*Methanocaldococcus infernus* ME), MemarMCM2 (*Methanoculleus marisnigri* JR1), MemarPol-II (*Methanoculleus marisnigri* JR1), Mesp-FS406PolB-1 (*Methanocaldococcus* sp. FS406-22), Mesp-FS406PolB-2 (*Methanocaldococcus* sp. FS406-22), Mesp-FS406PolB-3 (*Methanocaldococcus* sp. FS406-22), Msp-FS406-22LHR (*Methanocaldococcus* sp. FS406-22), Mfe-AG86Pol-1 (*Methanocaldococcus fervens* AG86), Mfe-AG86Pol-2 (*Methanocaldococcus fervens* AG86), MhuPol-II (*Methanospirillum hungateii* JF-1), MjaGF-6P (*Methanococcus jannaschii*), MjaHelicase (*Methanococcus jannaschii*), MjaHyp-1 (*Methanococcus jannaschii*), Mj aIF2 (*Methanococcus jannaschii*), MjaKlba (*Methanococcus jannaschii*), MjaPEP (*Methanococcus jannaschii*), MjaPol-1 (*Methanococcus jannaschii*), MjaPol-2 (*Methanococcus jannaschii*), MjaRFC-1 (*Methanococcus jannaschii*), MjaRFC-2 (*Methanococcus jannaschii*), MjaRFC-3 (*Methanococcus jannaschii*), MjaRNR-1 (*Methanococcus jannaschii*), MjaRNR-2 (*Methanococcus jannaschii*), MjaHyp-2 (*Methanococcus jannaschii*), MjaTFIIB (*Methanococcus jannaschii*), UDPGD (*Methanococcus jannaschii*), Mjar-Gyr (*Methanococcus jannaschii*), rPo1A' (*Methanococcus jannaschii*), Mja rPol A' (*Methanococcus jannaschii*), MkaCDC48 (*Methanopyrus kandleri* AV19), MkaEF2 (*Methanopyrus kandleri* AV19), MkaRFC (*Methanopyrus kandleri* AV19), MkaRtcB (*Methanopyrus kandleri* AV19), MkaVatB (*Methanopyrus kandleri* AV19), MthRIR1 (*Methanothermobacter thermautotrophicus*), Mvu-M7Helicase (*Methanocaldococcus vulcanius* M7), Mvu-M7Pol-1 (*Methanocaldococcus vulcanius* M7), Mvu-M7Pol-2 (*Methanocaldococcus vulcanius* M7), Mvu-M7Pol-3 (*Methanocaldococcus vulcanius* M7), UDPGD (*Methanocaldococcus vulcanius* M7), NeqPol-c (*Nanoarchaeum equitans* Kin4-M), NeqPol-n (*Nanoarchaeum equitans* Kin4-M), Nma-ATCC43099MCM (*Natrialba magadii* ATCC 43099), Nma-ATCC43099PolB-1 (*Natrialba magadii* ATCC 43099), Nma-ATCC43099PolB-2 (*Natrialba magadii* ATCC 43099), NphCDC21 (*Natronomonas pharaonis* DSM 2160), NphPo1B-2 (*Natronomonas pharaonis* DSM 2160), NphPo1B-1 (*Natronomonas pharaonis* DSM 2160), rPo1A" (*Natronomonas pharaonis* DSM 2160), PabCDC21-1 (*Pyrococcus abyssi*), PabCDC21-2 (*Pyrococcus abyssi*), PabIF2 (*Pyrococcus abyssi*), PabKlbA (*Pyrococcus abyssi*), PabLon (*Pyrococcus abyssi*), PabMoaa (*Pyrococcus abyssi*), PabPol-II (*Pyrococcus abyssi*), PabRFC-1 (*Pyrococcus abyssi*), PabRFC-2 (*Pyrococcus abyssi*), PabRIR1-1 (*Pyrococcus abyssi*), PabRIR1-2 (*Pyrococcus abyssi*), PabRIR1-3 (*Pyrococcus abyssi*), PabHyp-2 (*Pyrococcus abyssi*), PabVMA (*Pyrococcus abyssi*), ParRIR1 (*Pyrobaculum arsenaticum* DSM 13514), PfuCDC21 (*Pyrococcus furiosus*), PfuIF2 (*Pyrococcus furiosus*), PfuKlbA (*Pyrococcus furiosus*), PfuLon (*Pyrococcus furiosus*), PfuRFC (*Pyrococcus furiosus*), PfuRIR1-1 (*Pyrococcus furiosus*), PfuRIR1-2 (*Pyrococcus furiosus*), PfuHyp-2 (*Pyrococcus furiosus*), PfuTopA (*Pyrococcus furiosus*), PfuVMA (*Pyrococcus furiosus*), PhoCDC21-1 (*Pyrococcus horikoshii* OT3), PhoCDC21-2 (*Pyrococcus horikoshii* OT3), PhoIF2 (*Pyrococcus horikoshii* OT3), PhoKlbA (*Pyrococcus horikoshii* OT3), PhoLHR (*Pyrococcus horikoshii* OT3), PhoLon (*Pyrococcus horikoshii* OT3), PoII (*Pyrococcus horikoshii* OT3), PhoPol-II (*Pyrococcus horikoshii* OT3), PhoRFC (*Pyrococcus horikoshii* OT3), PhoRIR1 (*Pyrococcus horikoshii* OT3), PhoRadA (*Pyrococcus* horikoshii OT3), PhoVMA (*Pyrococcus horikoshii* OT3), PhoHyp-2 (*Pyrococcus horikoshii* OT3), Phor-Gyr (*Pyrococcus horikoshii* OT3), Psp-GBDPol (*Pyrococcus* species GB-D), Smar1471 (*Staphylothermus marinus* F1), PhoVMA (*Picrophilus torridus* DSM 9790), Tac-ATCC25905VMA (*Thermoplasma acidophilum* ATCC 25905), SmarMCM2 (*Staphylothermus marinus* F1), Tac-DSM1728VMA (*Thermoplasma acidophilum* DSM1728), Tsp-TYPol-1 (*Thermococcus aggregans*), Tsp-TYPol-2 (*Thermococcus aggregans*), Tsp-TYPol-3 (*Thermococcus aggregans*), TbaPol-II (*Thermococcus barophilus* MP), TfuPol-1 (*Thermococcus fumicolans*), ThyPol-1 (*Thermococcus hydrothermalis*), TfuPol-2 (*Thermococcus fumicolans*), ThyPol-2 (*Thermococcus hydrothermalis*), TkoCDC21-1 (*Thermococcus kodakaraensis* KOD1), TkoCDC21-2 (*Thermococcus kodakaraensis* KOD1), TkoHelicase (*Thermococcus kodakaraensis* KOD1), TkoIF2 (*Thermococcus kodakaraensis* KOD1), TkoKlbA (*Thermococcus kodakaraensis* KOD1), TkoLHR (*Thermococcus kodakaraensis* KOD1), Psp-KOD-Pol-1 (*Thermococcus kodakaraensis* KOD1), KODPol-2 (*Thermococcus kodakaraensis* KOD1), TkoPol-II (*Thermococcus kodakaraensis* KOD1), TkoRIR1-1 (*Thermococcus kodakaraensis* KOD1), TkoRFC (*Thermococcus kodakaraensis* KOD1), TkoRIR1-2 (*Thermococcus kodakaraensis* KOD1), TkoRadA (*Thermococcus kodakaraensis* KOD1), TkoTopA (*Thermococcus kodakaraensis* KOD1), Tkor-Gyr (*Thermococcus kodakaraensis* KOD1), T1iPo1-1 (*Thermococcus litoralis*), T1iPol-2 (*Thermococcus litoralis*), TmaPol (*Thermococcus marinus*), Ton-NA1LHR (*Thermococcus onnurineus* NA1), Ton-NA1Pol (*Thermococcus onnurineus* NA1), TpePol (*Thermococcus peptonophilus* strain SM2), Tsi-MM739Lon (*Thermococcus sibiricus* MM 739), Tsi-MM739Pol-1 (*Thermococcus sibiricus* MM 739), Tsi-MM739Pol-2 (*Thermococcus sibiricus* MM 739), Tsi-MM739RFC (*Thermococcus sibiricus* MM 739), AM4RtcB (*Thermococcus* sp. AM4), Tsp-AM4LHR (*Thermococcus* sp. AM4), Tsp-AM4Lon (*Thermococcus* sp. AM4), Tsp-AM4RIR1 (*Thermococcus* sp. AM4), Tsp-GE8Pol-2 (*Thermococcus* species GE8), Tsp-GE8Pol-1 (*Thermococcus* species GE8), Tsp-GTPol-1 (*Thermococcus* species GT), Tsp-GTPol-2 (*Thermococcus* species GT), Tsp-OGL-P20Pol (*Thermococcus* sp. OGL-20P), TthiPol (*Thermococcus thioreducens*), TziPol (*Thermococcus zilligii*), TvoVMA (*Thermoplasma volcanium* GSS1), Unc-ERSPFL (uncultured archaeon GZfos13E1), Unc-ERSRIR1 (uncultured archaeon GZfos9C4), Unc-MetRFSMCM2 (uncultured archaeon Rice Cluster I), and Unc-ERSRNR (uncultured archaeon GZfos10C7).

In the above list, the intein name provides information about the organism and the protein name given to a homolog of the protein that hosts the intein in a well studied organism. For example, in the name Ade-ER3PRP8, "Ade-ER3" refers to the organism *Ajellomyces dermatitidis* ER-3 and letters PRP8 to the protein name given to a homolog of the protein that hosts the intein in a well studied organism.

Most inteins contain conserved blocks or domains that mediate splicing. Splicing may include self-cleaving of inteins from the precursor protein molecules and ligation of the remaining protein fragments (the exteins). The domain involved in splicing is formed by the two terminal regions, which are separated by a small linker in mini-inteins or a homing endonuclease in larger inteins. The homing endonuclease cleaves DNA, aids intein propagations, and is disposable for intein splicing. There are four families of homing endonucleases classified by conserved sequence motifs, such as the C or E blocks. Homing endonucleases found in inteins generally belong to the dodecapeptide (DOD) family. Endonucleases of the DOD family contain one or two copies of a 10-residue sequence known as a dodecapeptide or LAGLIDADG motif. The homing endonuclease domain may be excised from the intein and replaced with an exogenous protein to create a modified intein. The modified intein may retain splicing ability of a natural non-modified intein.

The modified intein may be inserted internally into another protein. Prior to intein insertion, portions of the second protein may be referred to as an extein. An amino terminal (or amino extein) is an extein that is positioned prior to the amino-terminal residue of the modified intein. A carboxy terminal extein (or carboxy extein) is an extein that is positioned after the carboxy-terminal residue of the modified intein. The amino terminus of a carboxy terminal extein is fused to the carboxy terminus of the modified intein in an assembled multiprotein unit. The carboxy terminus of an amino terminal extein may be fused to the amino terminus of the modified intein in an assembled multiprotein unit. An intein modified protein can be constructed by inserting an intein immediately prior any C/S/T (Cys, Ser, Thr) position. The C/S/T position can be natural or introduced. Sites for inserting inteins within the selected proteins can be determined experimentally. To determine if an insertion site will allow splicing, the gene encoding the multiprotein unit can be constructed and cloned using known methods in the art, the multiprotein unit may be expressed, and tested for its ability to splice either spontaneously or under induction conditions. Intein insertion sites can be predicted. Methods for predicting and selecting intein insertion sites were described in U.S. patent application Ser. No. 12/590,444, filed Nov. 6, 2009 and in the article by James Apgar, Mary Ross, Xiao Zuo, Sarah Dohle, Derek Sturtevant, Binzhang Shen, Humberto dela Vega, Phillip Lessard, Gabor Lazar, R. Michael Raab, Apgar, J. et al., 2012, "A predictive model of intein insertion site for use in the engineering of molecular switches," PloS ONE 7 (5); e37355, doi:10,1371/journal, pone.0037355, both of which are incorporated by reference herein as if fully set forth. Intein insertion sites may be assessed by one or more methods based on: (i) the local sequence as described by a support vector machine (SVM), (ii) the distance of the site to the active site residues, and (iii) the proximity of the insertion site to a local secondary structure (e.g., a loop-β-sheet junction or a loop-α-helix junction). Intein insertion sites that can be used to control protein activity can be predicted and then tested experimentally.

In an embodiment, the activity of at least one of the first protein or the second protein within the multiprotein unit may be substantially reduced or inhibited.

In an embodiment, the activity of at least one of the first protein or the second protein within the multiprotein unit may be reduced to a level less than or equal to 50, 45, 35, 30, 25, 15, 10, 9, 8, 7, 6, 5, 4, 3, 2, or 1% of the activity of a native protein.

The activity of the first protein or second protein in a multiprotein unit may be changed because the multiprotein unit may splice either spontaneously or by exposure to induction conditions. The induction conditions may cause the intein to splice. At least one of the first protein or the second protein may have increased activity after modified intein cleavage, or splicing. At least one of the first protein or the second protein may have lower activity after modified intein cleavage or splicing. Induction conditions may be but are not limited to at least one condition selected from the group consisting of: an induction pH, an induction temperature, an induction pressure, an induction concentration of a compound, an induction compound, an induction mixture of compounds, an induction sound, an induction light, a change in amino acid phosphorylation, and a change in amino acid glycosilation. The induction condition may be the temperature at which an intein is induced to splice. The induction condition may be an induction temperature of 30° C., 37° C., 45° C., 50° C., or 55° C.

The multiprotein unit can be produced by standard molecular biological techniques. The intein, the first protein, the modified intein, or the second protein modified with intein can be subjected to mutation and then screened. Screening systems that can be utilized to screen include lambda phage, yeast, or other expression systems that allow production of the protein and/or testing of its physical and/or functional characteristics. From a modified intein or mutant modified intein population, candidates can be isolated and analyzed further. Further analysis may include DNA sequencing, functional assays, structural assays, enzyme activity assays, and monitoring changes in size, molecular weight, activity, structure, or splicing in response to induction conditions.

In an embodiment the amino acid sequence of at least one of the first protein or the second protein may comprise, consist essentially of, or consist of a sequence having at least 70, 72, 75, 80, 85, 90, 91, 92, 93, 94, 95, 96, 97, 98, 99, or 100% identity to a reference sequence selected from the group consisting of: SEQ ID NO: 1[P29600], SEQ ID NO: 2[P33558], SEQ ID NO: 3[Q7WUM6; AAQ], SEQ ID NO: 4[P77853], SEQ ID NO: 5 [P77853Cd], SEQ ID NO: 6[EU591743], SEQ ID NO: 7 [O77044; NtEG], SEQ ID NO: 8[O59952], SEQ ID NO: 170 [Savinase catalytic domain], and SEQ ID NO: 149 [proSavinase].

In an embodiment the amino acid sequence of the intein may comprise, consist essentially of, or consist of a sequence having at least 70, 72, 75, 80, 85, 90, 91, 92, 93, 94, 95, 96, 97, 98, 99, or 100% identity to a reference sequence selected from the group consisting of: SEQ ID NO: 66 [mTth], SEQ ID NO: 67[Pho_RadA], SEQ ID NO: 68[Tko_RadA], SEQ ID NO: 69[SceVMA], SEQ ID NO: 70[Pab_Lon], SEQ ID NO: 74[mVMA], and SEQ ID NO: 206 [Hwa_MCM-1].

In an embodiment the sequence of the modified intein may comprise, consist essentially of, or consist of a sequence having at least 70, 72, 75, 80, 85, 90, 91, 92, 93, 94, 95, 96, 97, 98, 99, or 100% identity to a reference sequence selected from the group consisting of: SEQ ID NO: 14[mTth:EU59], SEQ ID NO: 15 [Pho_RadA:EU59], SEQ ID NO: 16 [Tko_RadA:EU59], SEQ ID NO: 18 [Sce_VMA:P77Cd], SEQ ID NO: 134 [Hwa:O59-1], SEQ ID NO:135 [Hwa:O59-2], SEQ ID NO:136 [Hwa:O59-3], SEQ ID NO:137 [Hwa:O59-4], SEQ ID NO: 138 [Hwa:O59-5], SEQ ID NO: 139 [Hwa: O59-6], SEQ ID NO:140 [Hwa:O59-7], SEQ ID NO:141[Hwa: O59-8], SEQ ID NO:142 [Hwa: O59-9], SEQ ID NO:143 [mTth:O59_1], SEQ ID NO: 144 [mTth:O59_2], SEQ ID NO:145 [mTth:O59_3], SEQ ID NO:146 [mTth:O59_4], SEQ ID NO:147 [mTth:O59_5], SEQ ID NO:148 [mTth:O59_6], and SEQ ID NO: 232 [mTth:P77Cd].

In an embodiment, the amino acid sequence of the multiprotein unit may comprise, consist essentially of, or consist of a sequence having at least 70, 72, 75, 80, 85, 90, 91, 92, 93, 94, 95, 96, 97, 98, 99, or 100% identity to a reference sequence selected from the group consisting of: SEQ ID NO: 19 [NtEGS109:mTth:EU59], SEQ ID NO: 20 [NtEGT155:mTth:EU59], SEQ ID NO: 21 [NtEGS255: mTth:EU59], SEQ ID NO: 22 [NtEGS325:mTth:EU59], SEQ ID NO: 23 [NtEGC348:mTth:EU59], SEQ ID NO: 24 [NtEGS352:mTth:EU59], SEQ ID NO: 25 [NtEGS364: mTth:EU59], SEQ ID NO: 26 [NtEGT376:mTth:EU59], SEQ ID NO: 27 [NtEGS379:mTth:EU59], SEQ ID NO: 28 [P33S231:mTth:EU59] SEQ ID NO: 29 [P33S235:mTth: EU59], SEQ ID NO: 30 [P33S303:mTth:EU59], SEQ ID NO: 31 [P33S318:mTth:EU59], SEQ ID NO: 32 [AAQS121:mTtH:EU59], SEQ ID NO: 33 [AAQS138: mTtH:EU59], SEQ ID NO: 34 [AAQS140:mTtH:EU59], SEQ ID NO: 35 [AAQS146:mTtH:EU59], SEQ ID NO: 36 [AAQS179:mTtH:EU59], SEQ ID NO: 37 [AAQS187: mTtH:EU59], SEQ ID NO: 38 [AAQS222:mTtH:EU59], SEQ ID NO: 39 [AAQS249:mTtH:EU59], SEQ ID NO: 40 [AAQS251:mTtH:EU59], SEQ ID NO: 41 [NtEGS352: mTth-c:EU59], SEQ ID NO: 42 [NtEGS364:mTth-c:EU59], SEQ ID NO: 43 [NtEGS149:Pho_RadA:EU59], SEQ ID NO: 44 [NtEGT179:Pho_RadA: EU59], SEQ ID NO: 45 [NtEGT200:Pho_RadA: EU59], SEQ ID NO: 46 [NtEGS352:Pho_RadA: EU59], SEQ ID NO: 47 [NtEGS149:Tko_RadA:EU59], SEQ ID NO: 48 [NtEGT179:Tko_RadA:EU59], SEQ ID NO: 49 [NtEGT200:Tko_RadA:EU59], SEQ ID NO: 50 [NtEGS352:Tko_RadA:EU59], SEQ ID NO: 51 [iproSavS135:mVMA:P77Cd], SEQ ID NO: 52 [iproSavS265: mVMA:P77Cd], SEQ ID NO: 53 [iproSavS269:mVMA: P77Cd], SEQ ID NO: 54 [iproSavS293:mVMA:P77Cd], SEQ ID NO: 55 [iproSavS312:mVMA:P77Cd], SEQ ID NO: 56 [iproSavS317:mVMA:P77Cd], SEQ ID NO: 57 [iproSavS326:mVMA:P77Cd], SEQ ID NO: 171[iproSavS46:mTth:EU59], SEQ ID NO: 172 [iproSavS62:mTth: EU59], SEQ ID NO: 173 [iproSavT47:mTth:EU59], SEQ ID NO: 174 [iproSavS86:mTth:EU59], SEQ ID NO: 175 [iproSavS100:mTth:EU59], SEQ ID NO: 176 [iproSavT109:mTth:EU59], SEQ ID NO: 177 [iproSavS135: mTth:EU59], SEQ ID NO: 178 [iproSavT148:mTth:EU59], SEQ ID NO: 179 [iproSavS166:mTth:EU59], SEQ ID NO: 180 [iproSavT167:mTth:EU59], SEQ ID NO: 181 [iproSavS196:mTth:EU59], SEQ ID NO: 182 [iproSavS208: mTth:EU59], SEQ ID NO: 183 [iproSavS239:mTth:EU59], SEQ ID NO: 184 [iproSavT243:mTth:EU59], SEQ ID NO: 185 [iproSavS269:mTth:EU59], SEQ ID NO: 186 [iproSavT285:mTth:EU59], SEQ ID NO: 187 [iproSavS293: mTth:EU59], SEQ ID NO: 188 [iproSavS317:mTth:EU59], SEQ ID NO: 189 [iproSavT318:mTth:EU59], SEQ ID NO: 190 [iproSavT329:mTth:EU59], SEQ ID NO: 209 [iproSavS135:mTth:O59_1], SEQ ID NO: 210 [iproSavS135: mTth:O59_2], SEQ ID NO: 211 [iproSavS135:mTth: O59_3], SEQ ID NO: 212 [iproSavS135:mTth:O59_4], SEQ ID NO: 213 [iproSavS135:mTth:O59_5], SEQ ID NO: 214 [iproSavS135:mTth:O59_6], SEQ ID NO: 215 [iproSavS317:Hwa:O59_1], SEQ ID NO: 216 [iproSavS317: Hwa:O59_2], SEQ ID NO: 217 [iproSavS317:Hwa:O59_3], SEQ ID NO: 218 [iproSavS317:Hwa:O59_4], SEQ ID NO: 219 [iproSavS317:Hwa:O59_5], SEQ ID NO: 220 [iproSavS317:Hwa:O59_6], SEQ ID NO; 221 [iproSavS317: Hwa:O59_7], SEQ ID NO: 222 [iproSavS317:Hwa:O59_8], SEQ ID NO: 223 [iproSavS317:Hwa:O59_9], SEQ ID NO: 233 [iproSavS135:mTth:P77Cd], SEQ ID NO: 234 [iproSavS269:mTth:P77Cd], SEQ ID NO: 235 [iproSavS293: mTth:P77Cd], SEQ ID NO: 236 [iproSavS317:mTth: P77Cd], SEQ ID NO: 237 [iproSavS312:mVMA-c:P77Cd], and SEQ ID NO: 238 [iproSavS326:mVMA-c:P77Cd]. The name of the multiprotein unit may provide information about the type of the first protein, the insertion site of the modified intein within the first protein, the type of the modified intein and the type of the second protein. For example, in the name NtEGS109:mTth:EU59, "NtEGS109" refers to cellulase NtEG and the insertion site of the "mTth"

intein immediately prior to the amino acid S109 within the sequence of the NtEG, "mTth" refers to the miniature intein of the DNA polymerase III alpha subunit from the thermophilic, non-pathogenic bacterium *Thermus thermophilus* strain HB27, and "EU59" refers to xylanase EU591743.

In an embodiment, fragments and variants of proteins or polypeptides herein are also provided. Variants may include conservative amino acid substitutions, i.e., substitutions with amino acids having similar properties. Conservative substitutions may be a polar for polar amino acid (Glycine (G), Serine (S), Threonine (T), Tyrosine (Y), Cysteine (C), Asparagine (N) and Glutamine (Q)); non-polar for non-polar amino acid (Alanine (A), Isoleucine (I), Thyptophan (W), Leucine (L), Proline (P), Methionine (M), Phenylalanine (F)); acidic for acidic amino acid (Aspartic acid (D), Glutamic acid (E)); basic for basic amino acid (Arginine (R), Histidine (H), Lysine (K)); charged for charged amino acids Aspartic acid (D), Glutamic acid (E), Histidine (H), Lysine (K) and Arginine (R)); hydrophobic for hydrophobic amino acid (Alanine (A), Leucine (L), Isoleucine (I), Valine (V), Proline (P), Phenylalanine (F), Tryptophan (W) and Methionone (M)). Conservative nucleotide substitutions may be made in a nucleic acid sequence by substituting a codon for an amino acid with a different codon for the same amino acid, or for a codon coding for a conservative amino acid substitution. Variants may include non-conservative substitutions.

In an embodiment, fragments of a first protein, or a second protein are provided. Fragments or parts thereof may include 100, 150, 200, 300, 400, 600, contiguous amino acids or more. Fragments may retain the functionality of the first protein, or the second protein. The functionality of a protein, variants or fragments thereof, may be determined using any known methods.

Determining percent identity of two amino acid sequences or two nucleic acid sequences may include aligning and comparing the amino acid residues or nucleotides at corresponding positions in the two sequences. If all positions in two sequences are occupied by identical amino acid residues or nucleotides then the sequences are said to be 100% identical. Percent identity may be measured by the Smith Waterman algorithm (Smith T F, Waterman M S 1981 "Identification of Common Molecular Subsequences," J Mol Biol 147: 195-197, which is incorporated herein by reference as if fully set forth).

In an embodiment, an expression cassette that includes a nucleic acid encoding a multiprotein unit is provided. The multiprotein unit may include a first protein, a second protein, and an intein. The first protein may be fused internally to the intein, and together the first protein internally fused to the intein is referred to as a modified intein. The modified intein may be fused internally to the second protein and may be capable of effecting splicing of the multiprotein unit.

In an embodiment, the nucleic acid sequence encoding the first protein, or the second protein may comprise, consist essentially of, or consist of a sequence with at least 70, 72, 75, 80, 85, 90, 91, 92, 93, 94, 95, 96, 97, 98, 99, or 100% identity to a reference sequence selected from the group consisting of: SEQ ID NO: 58 [P29600], SEQ ID NO: 59[P33558], SEQ ID NO: 60 [Q7WUM6; AAQ], SEQ ID NO: 61[P77853], SEQ ID NO: 62 [P77853Cd], SEQ ID NO: 63[EU591743], SEQ ID NO: 64 [O77044], SEQ ID NO: 65[O59952], SEQ ID NO: 207 [proSavinase], and SEQ ID NO: 208 [Savinase catalytic domain].

In an embodiment, the nucleic acid sequence encoding the intein may comprise, consist essentially of, or consist of a sequence with at least 70, 72, 75, 80, 85, 90, 91, 92, 93, 94, 95, 96, 97, 98, 99, or 100% identity to a reference sequence selected from the group consisting of: SEQ ID NO: 66 [mTth], SEQ ID NO: 67 [Pho_RadA], SEQ ID NO: 68 [Tko_RadA], SEQ ID NO: 69 [SceVMA], SEQ ID NO: 70 [Pab_Lon], SEQ ID NO: 74 [mVMA], and SEQ ID NO: 206 [Hwa_MCM-1].

In an embodiment, the nucleic acid sequence encoding the modified intein may comprise, consist essentially of, or consist of a sequence with at least 70, 72, 75, 80, 85, 90, 91, 92, 93, 94, 95, 96, 97, 98, 99, or 100% identity to a reference sequence selected from the group consisting of: SEQ ID NO: 71[mTth:EU59], SEQ ID NO: 72[Pho_RadA:EU59], SEQ ID NO: 73 [Tko_RadA:EU59], SEQ ID NO: 75 mVMA:P77Cd], SEQ ID NO: 119 [Hwa: O59-1], SEQ ID NO:120 [Hwa: O59-2], SEQ ID NO:121 [Hwa: O59-3], SEQ ID NO:122 [Hwa: O59-4], SEQ ID NO: 123 [Hwa: O59-5], SEQ ID NO: 124 [Hwa: O59-6], SEQ ID NO:125 [Hwa: O59-7], SEQ ID NO:126 [Hwa: O59-8], SEQ ID NO:127 [Hwa: O59-9], SEQ ID NO:128 [mTth: O59_1], SEQ ID NO: 129 [mTth: O59_2], SEQ ID NO:130 [mTth: O59_3], SEQ ID NO:131 [mTth: O59_4], SEQ ID NO:132 [mTth: O59_5], SEQ ID NO:133 [mTth: O59_6], and SEQ ID NO: 225 [mTth:P77Cd].

In an embodiment, the nucleic acid sequence encoding the multiprotein unit may comprise, consist essentially of, or consist of a sequence with at least 70, 72, 75, 80, 85, 90, 91, 92, 93, 94, 95, 96, 97, 98, 99, or 100% identity to a reference sequence selected from the group consisting of: SEQ ID NO: 76 [NtEGS109:mTth:EU59], SEQ ID NO: 77 [NtEGT155:mTth:EU59], SEQ ID NO: 78 [NtEGS255:mTth:EU59], SEQ ID NO: 79 [NtEGS325:mTth:EU59], SEQ ID NO: 80 [NtEGC348:mTth:EU59], SEQ ID NO: 81 [NtEGS352:mTth:EU59], SEQ ID NO: 82 [NtEGS364:mTth:EU59], SEQ ID NO: 83 [NtEGT376:mTth:EU59], SEQ ID NO: 84 [NtEGS379:mTth:EU59], SEQ ID NO: 85 [P33S231:mTth:EU59] SEQ ID NO: 86 [P33S235:mTth:EU59], SEQ ID NO: 87 [P33S303:mTth:EU59], SEQ ID NO: 88 [P33S318:mTth:EU59], SEQ ID NO: 89 [AAQS121:mTth:EU59], SEQ ID NO: 90 [AAQS138:mTth:EU59], SEQ ID NO: 91 [AAQS140:mTth:EU59], SEQ ID NO: 92 [AAQS146:mTth:EU59], SEQ ID NO: 93 [AAQS179:mTth:EU59], SEQ ID NO: 94 [AAQS187:mTth:EU59], SEQ ID NO: 95 [AAQS222:mTth:EU59], SEQ ID NO: 96 [AAQS249:mTth:EU59], SEQ ID NO: 97 [AAQS251:mTth:EU59], SEQ ID NO: 98 [NtEGS352:mTth-c:EU59], SEQ ID NO: 99 [NtEGS364:mTth-c:EU59], SEQ ID NO: 100 [NtEGS149:Pho_RadA:EU59], SEQ ID NO: 101 [NtEGT179:Pho_RadA:EU59], SEQ ID NO: 102 [NtEGT200:Pho_RadA:EU59], SEQ ID NO: 103 [NtEGS352:Pho_RadA:EU59], SEQ ID NO: 104 [NtEGS149:Tko_RadA:EU59], SEQ ID NO: 105 [NtEGT179:Tko_RadA:EU59], SEQ ID NO: 106 [NtEGT200:Tko_RadA:EU59], SEQ ID NO: 107 [NtEGS352:Tko_RadA:EU59], SEQ ID NO: 108 [iproSavS135:mVMA:P77Cd], SEQ ID NO: 109 [iproSavS265:mVMA:P77Cd], SEQ ID NO: 110 [iproSavS269:mVMA:P77Cd], SEQ ID NO: 111 [iproSavS293:mVMA:P77Cd], SEQ ID NO: 112 [iproSavS312:mVMA:P77Cd], SEQ ID NO: 113 [iproSavS317:mVMA:P77Cd], SEQ ID NO: 114 [iproSavS326:mVMA:P77Cd], SEQ ID NO: 150 [iproSavS46:mTth:EU59], SEQ ID NO: 151 [iproSavS62:mTth:EU59], SEQ ID NO: 152 [iproSavT47:mTth:EU59], SEQ ID NO: 153 [iproSavS86:mTth:EU59], SEQ ID NO: 154 [iproSavS100:mTth:EU59], SEQ ID NO: 155 [iproSavT109:mTth:EU59], SEQ ID NO: 156 [iproSavS135:mTth:EU59], SEQ ID NO: 157 [iproSavT148:mTth:EU59], SEQ ID NO: 158 [iproSavS166:mTth:EU59], SEQ ID NO: 159 [iproSavT167:mTth:EU59], SEQ ID NO: 160 [iproSavS196:mTth:EU59], SEQ ID NO: 161 [iproSavS208:mTth:EU59], SEQ ID NO: 162 [iproSavS239:mTth:EU59], SEQ ID NO: 163 [iproSavT243:mTth:EU59], SEQ ID NO: 164 [iproSavS269:mTth:EU59], SEQ ID NO: 165 [iproSavT285:mTth:EU59], SEQ ID NO: 166 [iproSavS293:mTth:EU59], SEQ ID NO: 167 [iproSavS317:mTth:EU59], SEQ ID NO: 168 [iproSavT318:mTth:EU59], SEQ ID NO: 169 [iproSavT329:mTth:EU59], SEQ ID NO: 191 [iproSavS135:mTth:O59_1], SEQ ID NO: 192 [iproSavS135:mTth:O59_2], SEQ ID NO: 193 [iproSavS135:mTth:O59_3], SEQ ID NO: 194 [iproSavS135:mTth:O59_4], SEQ ID NO: 195 [iproSavS135:mTth:O59_5], SEQ ID NO: 196 [iproSavS135:mTth:O59_6], SEQ ID NO: 197 [iproSavS317:Hwa:O59_1], SEQ ID NO: 198 [iproSavS317:Hwa:O59_2], SEQ ID NO: 199 [iproSavS317:Hwa:O59_3], SEQ ID NO: 200 [iproSavS317:Hwa:O59_4], SEQ ID NO: 201 [iproSavS317:Hwa:O59_5], SEQ ID NO: 202 [iproSavS317:Hwa:O59_6], SEQ ID NO; 203 [iproSavS317:Hwa:O59_7], SEQ ID NO: 204 [iproSavS317:Hwa:O59_8], SEQ ID NO: 205 [iproSavS317:Hwa:O59_9], SEQ ID NO: 226 [iproSavS135:mTth:P77Cd], SEQ ID NO: 227 [iproSavS269:mTth:P77Cd], SEQ ID NO: 228 [iproSavS293:mTth:P77Cd], SEQ ID NO: 229 [iproSavS317:mTth:P77Cd], SEQ ID NO: 230 [iproSavS312:mVMA-c:P77Cd], and SEQ ID NO: 231 [iproSavS326:mVMA-c:P77Cd].

In an embodiment, a transformation vector that includes any one of expression cassettes herein is provided. The vector may include a nucleic acid sequence having at least 70, 72, 75, 80, 85, 90, 91, 92, 93, 94, 95, 96, 97, 98, 99, or 100% identity to a reference sequence selected from the group consisting of: SEQ ID NO: 115 [pAG4535], SEQ ID NO: 116 [pAG4536], SEQ ID NO: 117 [pAG4537], and SEQ ID NO: 118 [pAG4538].

In an embodiment, the nucleic acid encoding the multiprotein unit may further be operably connected to at least one regulatory sequence. In this context, operably connected means that the regulatory sequence imparts its function on the nucleic acid. For example, a regulatory sequence may be a promoter, and the operably connected promoter would control expression of the nucleic acid.

The regulatory sequence may be a promoter to provide expression of the multiprotein unit in a host. The promoter may be a constitutive promoter or, tissue specific, or an inducible promoter. The constitutive promoter may provide transcription of the nucleic acids or polynucleotide sequences throughout the host organism in most cells, tissues, and organs, and during many but not necessarily all stages of development. The promoter may be an inducible promoter, which initiates transcription of the polynucleotide sequences only when exposed to a particular chemical or environmental stimulus. The promoter may be specific to a particular developmental stage, organ or tissue. A tissue specific promoter may be capable of initiating transcription in a particular tissue.

The promoter may be a plant promoter. A constitutive plant promoter herein may be the rice Ubiquitin 3 promoter (OsUbi3P) or maize the phosphoenolpyruvate carboxylase promoter (ZmPepCP). Other known constitutive plant promoters may be used, and include but are not limited to Cauliflower Mosaic Virus (CaMV) 35S promoter, the Cestrum Yellow Leaf Curling Virus promoter (CMP) or the CMP short version (CMPS), the Rubisco small subunit promoter, the rice actin promoter (OsAct1P) and the maize ubiquitin promoter (ZmUbi1P). The tissue specific plant promoter may include the seed-specific promoter. The seed specific promoter may be but is not limited to the rice GluB4 promoter or the maize zein promoter. Plant tissue that may be targeted by a tissue specific promoter may be but is not limited to a stem, leaves, trichomes, anthers, or seed.

The promoter may be a promoter that drives the expression of the multiprotein units in microbes. Microbes where the multiprotein unit may be expressed may include but are not limited to E. coli and yeast. The promoter may be the E. coli lac promoter for expression of the multiprotein in the presence of an inducing agent; e.g., lactose or IPTG. The promoter may be the T7 promoter and T7 RNA polymerase may specifically and constitutively transcribe the multiprotein unit downstream of the T7 promoter. The promoter may be the Gal4 promoter, and the multiprotein unit may be expressed in yeast under the Gal4 promoter, which can be induced by galactose in the culture medium.

The promoter may be used to drive the expression of the multiprotein units in mammalian cells or insect cells. The promoter may be but is not limited to Cytomegalovirus (CMV) promoter for high-level expression in a wide variety of mammalian cell lines, human elongation factor 1a-subunit (EF1-1α) promoter for high-level expression, human ubiquitin C (Ubc) promoter for high-level expression that is equivalent across a broad range of species and tissue types, Simian virus 40 (SV40) promoter for high-level expression, and Murine Phosphoglycerate Kinase-1 (PGK) promoter for long-term persistent expression in cells that are susceptible to promoter silencing from methylation or histone deacetylation, such as undifferentiated embryonic stem (ES) cells.

The regulatory sequence may be a terminator sequence, which terminates transcription of the nucleic acid. A terminator sequence may be included at the 3' end of a transcriptional unit of the expression cassette. The terminator may be derived from a variety of host genes. The terminator may be a plant terminator. The plant terminator may be a terminator sequence from the nopaline synthase (Nos) or octopine synthase (Ocs) genes of Agrobacterium tumefaciens. The plant terminator sequence may be the CaMV 35S terminator from CaMV, or any of the 3'UTR sequences shown to terminate the transgene transcription in plants. For example, the maize PepC terminator (3'UTR) can be used.

In an embodiment, a host expressing a multiprotein unit is provided. The multiprotein unit may include a first protein, a second protein and an intein. The first protein may be fused internally to the intein, and in combination the first protein fused to the intein may be referred to as a modified intein. The modified intein may be fused internally to the second protein. The modified intein may be capable of effecting splicing of the multiprotein unit. The activity of at least one of the first or the second protein may be substantially reduced or inhibited in the host that expresses the multiprotein unit. The activity of at least one of the first or the second protein may be restored upon splicing of the multiprotein unit in the host. The host may express the first protein, or the second protein. The host may express the first protein and the second protein. The host may express any protein described herein. The host may express the first protein selected from the group consisting of: a protease, a phytase, an amylase, an invertase, a xylanase, an endoglucanase, an exoglucanase, a feruloyl esterase, a lipase, and a cellulase. The host may express the second protein selected from the group consisting of: a protease, a phytase, an amylase, an invertase, a xylanase, an endoglucanase, an exoglucanase, a feruloyl esterase, a lipase, and a cellulase. The host may express the first protein or the second protein selected from the group consisting of: EC3.4.99 proteases, EC3.4.21.62 proteases, keratinases, serine proteases, alkaline proteases, metallo proteases, cysteine proteases, aspartate proteases, ATP-dependent proteases, and Subtilisin family proteases. The host may express a Savinase. The host may express the first protein and the second protein selected from the same group. The protein selected as the first protein may differ from the protein selected as the second protein. The protein selected as the first protein may be the protein selected as the second protein.

In an embodiment the host may contain and/or express any of the expression cassettes herein.

The host may be, but is not limited to, a plant, a yeast, a bacterium, and a phage. The host may be a cell. The cell may be but is not limited to a plant cell, a microbial cell, a fungal cell, a mammalian cell, or an insect cell. The cell may be the human HEK293 cell, the mouse NIH-3T3 cell, the *Drosophila* S2 cell, or the Sf9 cell.

The host may be a microorganism. The microorganism may be but is not limited to *Bacillus subtilus, B. lentus, B. licheniformis, Escherichia coli, Saccharomyces* ssp., *S. cerevisiae, Pichia* ssp., and *P. pastoris*.

The host may be an expression host. An expression host may be tested for expression of the first protein and/or the second protein using standard methods known in the art. Expression hosts may be microbial expression hosts. Microbial expression hosts may be single celled bacteria. Expression hosts may be fungal, or archeal hosts, plant expression hosts, insect cell expression hosts, viral expression hosts, phage expression hosts, or mammalian expression hosts. Multiprotein units may be expressed in expression hosts or in in vitro expression systems. Microbial expression hosts may be useful because of their ease of use and the broad technology platforms that are readily available for these organisms. A microbial expression host may be *B. subtilus, B. lentus, B. licheniformis, Escherichia coli, Saccharomyces* ssp., *S. cerevisiae, Pichia* ssp., *P. pastoris*, or other known in the art.

In an embodiment, a method for producing multiple proteins is provided. The method may include contacting a host cell with a transformation vector. The transformation vector may include an expression cassette. The expression cassette may include a nucleic acid encoding any multiprotein unit described herein. The multiprotein unit may include a first protein, a second protein and an intein. The first protein may be fused internally to the intein, and in combination the first protein internally fused to the intein may be referred to as a modified intein. The modified intein may be fused internally to the second protein. The modified intein may be capable of effecting splicing of the multiprotein unit.

In an embodiment, the step of contacting the host may include transforming the host cell with a vector that includes an expression cassette. The expression cassette may include a nucleic acid encoding the multiprotein unit. The transformation may be but is not limited to an *Agrobacterium*-mediated transformation, electroporation with a plasmid DNA, a DNA uptake, a biolistic transformation, a virus-mediated transformation, or a protoplast transformation. The transformation may be any other transformation procedure suitable for a particular host. The method may include selecting the host cell that includes the expression cassette and expresses the multiprotein unit. The method may include regenerating the host cell into a multicellular organism. The method may include multiplying the host cell to obtain a plurality of the host cells that include the expression cassette and express the multiprotein unit.

In an embodiment, the modified intein may cause spontaneous splicing of the multiprotein unit in the host.

In an embodiment, the method may include inducing splicing of the multiptrotein unit in response to an induction condition. The method may include exposing the host to an induction condition that may cause self-cleavage of the modified intein from the multiprotein unit, and ligation of the remaining exteins. The method may result in the release of the first protein, or the second protein, or both the first protein and the second protein from the multiprotein unit. If the activity of the first protein or the second protein within the multiprotein unit was inhibited or substantially reduced, splicing may lead to restoration of the activity of the first protein or the second protein to a level of the respective native protein.

The induction condition may be an induction temperature, an induction pH, an induction light, an induction compound, an induction concentration of a compound and an induction concentration of an ion.

The induction temperature may be any temperature. The induction temperature may be a high temperature. The high temperature may be a temperature higher than 37° C. The induction temperature may be a low temperature. The low temperature may be a temperature lower than 37° C. The induction temperature may be a temperature of 37° C., 35° C., 30° C., 25° C., 20° C., less than 37° C., less than 35° C., less than 30° C., less than 25° C., less than 20° C., 37° C. to 35° C., 35° C. to 30° C., 30° C. to 25° C., 25° C. to 20° C., or to less than 20° C. The induction temperature may be a temperature of 37° C., 40° C., 50° C., 60° C., 70° C., 80° C., 90° C., higher than 37° C., higher than 40° C., higher than 50° C., higher than 60° C., higher than 70° C., higher than 80° C., higher than 90° C., 37° C. to 40° C., 40° C. to 50° C., 50° C. to 60° C., 60° C. to 70° C., 70° C. to 80° C., or 80° C. to 90° C.

The induction compound may be water, a detergent, a surfactant, a chelating agent, zinc, EDTA, and phytic acid.

In an embodiment, a method for regulating expression of one or more protein is provided. The method may include allowing a modified intein in a multiprotein unit to splice the multiprotein unit. The multiprotein unit may be any multiprotein unit described herein. The method may include expressing a multiprotein unit in a host. The multiprotein unit may include a first protein, a second protein and an intein. The first protein may be fused internally to the intein, and in combination the first protein internally fused to the intein may be referred to as a modified intein. The modified intein may be fused internally to the second protein in such a position as to substantially reduce or inhibit the activity of the second protein. The modified intein may be capable of effecting splicing of the multiprotein unit.

The intein may be fused to the first protein in such a position as to substantially reduce or inhibit the activity of the first protein. In the multiprotein unit, the activity of the second protein may be reduced while the first protein may be active. The activity of the first protein and the second protein may be substantially reduced or inhibited. A substantially reduced activity of the first protein, or the second protein within the multiprotein unit may include activity reduced by 10, 15, 20, 25, 30, 35, 40 45, 50, 55, 60, 65, 70, 75, 80, 85, 90, 95, or 100% compared to the first protein, or the second protein, released from the multiprotein unit, or a percentage in a range between any two of the foregoing percentages. At least one of the first protein or the second protein may be a protease. As used herein, "protease" refers to an enzyme or portion thereof that catalyzes hydrolysis of peptide bonds. The first protein, or the second protein may have at least 40% of the activity of the amino acid sequence or protein having the activity of catalyzing hydrolysis of peptide bonds. A variant of the first protein, or the second protein may have at least 40% activity compared to the respective native sequence. A fragment of the first protein, or the second protein may have at least 40% compared to the respective native sequences having full length.

In an embodiment, the modified intein may cause spontaneous splicing of the multiprotein unit.

In an embodiment, the method includes exposing the multiprotein unit to an induction condition that causes the modified intein to splice. The induction condition may be but is not limited to at least one of an induction temperature, an induction pH, an induction light, an induction compound, an induction concentration of a compound, and an induction concentration of an ion. The activity of at least the first protein or the second protein may be restored upon splicing of the multiprotein unit.

EMBODIMENTS

The following list includes particular embodiments. The list, however, is not limiting and does not exclude the embodiments otherwise described herein or alternate embodiments.

1. A multiprotein unit comprising i) a modified intein including a first protein and an intein, and ii) a second protein, wherein the first protein is fused internally to the intein, the modified intein is fused internally to the second protein, and the modified intein is capable of effecting splicing of the multiprotein unit.

2. The multiprotein unit of embodiment 1, wherein at least one of the first protein or the second protein is selected from the group consisting of: a protease, a phytase, an amylase, an invertase, a xylanase, an endoglucanase, an exoglucanase, a feruloyl esterase, a lipase, and a cellulase.

3. The multiprotein unit of any one or more of embodiments 1-2, wherein the protein selected as the first protein differs from the protein selected as the second protein.

4. The multiprotein unit of any one or more of embodiments 1-3, wherein the intein is selected from the group consisting of: mTth, Pho_RadA, Tko_RadA, Sce_VMA, mVMA, Pab_Lon and Hwa_MCM-1.

5. The multiprotein unit of any one or more of embodiments 1-4, wherein the modified intein is inducible to cause splicing of the multiprotein unit by exposure of the multiprotein unit to an induction condition.

6. The multiprotein unit of any one or more of embodiments 1-5, wherein the induction condition is at least one condition selected from the group consisting of: an induction temperature, an induction pH, an induction light, an induction compound, an induction concentration of a compound, and an induction concentration of an ion.

7. The multiprotein unit of any one or more of embodiments 1-4, wherein the modified intein splices spontaneously.

8. The multiprotein unit of any one or more of embodiments 1-7, wherein a sequence of at least one of the first protein or the second protein has at least 90% identity to a reference sequence selected from the group consisting of: SEQ ID NO: 1[P29600], SEQ ID NO: 2[P33558], SEQ ID NO: 3[Q7WUM6; AAQ], SEQ ID NO: 4[P77853], SEQ ID NO: 5 [P77853Cd], SEQ ID NO: 6[EU591743], SEQ ID NO: 7 [O77044; NtEG], SEQ ID NO: 8[O59952], SEQ ID NO: 17 [Savinase catalytic domain], and SEQ ID NO: 149 [proSavinase].

9. The multiprotein unit of any one or more of embodiments 1-6 and 8, wherein a sequence of the intein has at least 90% identity to a reference sequence selected from the group consisting of: SEQ ID NO: 9 [mTth], SEQ ID NO: 10 [Pho_RadA], SEQ ID NO: 11 [Tko_RadA], SEQ ID NO: 12 [SceVMA], SEQ ID NO: 13[Pab_Lon], SEQ ID NO: 17[mVMA], and SEQ ID NO: 224 [Hwa_MCM-1].

10. The multiprotein unit of any one or more of embodiments 1-6 and 8-9, wherein a sequence of the modified intein has at least 90% identity to a reference sequence selected from the group consisting of: SEQ ID NO: 14[mTth:EU59], SEQ ID NO: 15 [Pho_RadA:EU59], SEQ ID NO: 16 [Tko_RadA:EU59], SEQ ID NO: 18 [Sce_VMA:P77Cd], SEQ ID NO: 134 [Hwa:O59-1], SEQ ID NO:135 [Hwa: O59-2], SEQ ID NO:136 [Hwa:O59-3], SEQ ID NO:137 [Hwa:O59-4], SEQ ID NO: 138 [Hwa:O59-5], SEQ ID NO: 139 [Hwa: O59-6], SEQ ID NO:140 [Hwa:O59-7], SEQ ID NO:141[Hwa: O59-8], SEQ ID NO:142 [Hwa: O59-9], SEQ ID NO:143 [mTth:O59_1], SEQ ID NO: 144 [mTth: O59_2], SEQ ID NO:145 [mTth: O59_3], SEQ ID NO:146 [mTth:O59_4], SEQ ID NO:147 [mTth:O59_5], SEQ ID NO:148 [mTth:O59_6], and SEQ ID NO: 232 [mTth: P77Cd].

11. The multiprotein unit of any one or more of embodiments 1-6 and 8-10, wherein a sequence of the multiprotein unit has at least 90% identity to a reference sequence selected from the group consisting of: SEQ ID NO: 19 [NtEGS109:mTth:EU59], SEQ ID NO: 20 [NtEGT155: mTth:EU59], SEQ ID NO: 21 [NtEGS255:mTth:EU59], SEQ ID NO: 22 [NtEGS325:mTth:EU59], SEQ ID NO: 23 [NtEGC348:mTth:EU59], SEQ ID NO: 24 [NtEGS352: mTth:EU59], SEQ ID NO: 25 [NtEGS364:mTth:EU59], SEQ ID NO: 26 [NtEGT376:mTth:EU59], SEQ ID NO: 27 [NtEGS379:mTth:EU59], SEQ ID NO: 28 [P33S231:mTth: EU59] SEQ ID NO: 29 [P33S235:mTth:EU59], SEQ ID NO: 30 [P33S303:mTth:EU59], SEQ ID NO: 31 [P33S318: mTth:EU59], SEQ ID NO: 32 [AAQS121:mTtH:EU59], SEQ ID NO: 33 [AAQS138:mTtH:EU59], SEQ ID NO: 34 [AAQS140:mTtH:EU59], SEQ ID NO: 35 [AAQS146: mTtH:EU59], SEQ ID NO: 36 [AAQS179:mTtH:EU59], SEQ ID NO: 37 [AAQS187:mTtH:EU59], SEQ ID NO: 38 [AAQS222:mTtH:EU59], SEQ ID NO: 39 [AAQS249: mTtH:EU59], SEQ ID NO: 40 [AAQS251:mTtH:EU59], SEQ ID NO: 41 [NtEGS352:mTth-c:EU59], SEQ ID NO: 42 [NtEGS364:mTth-c:EU59], SEQ ID NO: 43 [NtEGS149: Pho_RadA:EU59], SEQ ID NO: 44 [NtEGT179: Pho_RadA: EU59], SEQ ID NO: 45 [NtEGT200: Pho_RadA: EU59], SEQ ID NO: 46 [NtEGS352: Pho_RadA: EU59], SEQ ID NO: 47 [NtEGS149: Tko_RadA: EU59], SEQ ID NO: 48 [NtEGT179: Tko_RadA: EU59], SEQ ID NO: 49 [NtEGT200: Tko_RadA: EU59], SEQ ID NO: 50 [NtEGS352: Tko_RadA: EU59], SEQ ID NO: 51 [iproSavS135: mVMA: P77Cd], SEQ ID NO: 52 [iproSavS265: mVMA:P77Cd], SEQ ID NO: 53 [iproSavS269:mVMA: P77Cd], SEQ ID NO: 54 [iproSavS293: mVMA: P77Cd], SEQ ID NO: 55 [iproSavS312: mVMA: P77Cd], SEQ ID NO: 56 [iproSavS317: mVMA: P77Cd], SEQ ID NO: 57 [iproSavS326: mVMA: P77Cd], SEQ ID NO: 171[iproSav S46-mTth:EU59], SEQ ID NO: 172 [iproSav S62:mTth: EU59], SEQ ID NO: 173 [iproSav T47:mTth:EU59], SEQ ID NO: 174 [iproSav S86:mTth:EU59], SEQ ID NO: 175 [iproSav S100:mTth:EU59], SEQ ID NO: 176 [iproSav T109:mTth:EU59], SEQ ID NO: 177 [iproSav S135:mTth: EU59], SEQ ID NO: 178 [iproSav T148:mTth:EU59], SEQ ID NO: 179 [iproSav S166:mTth:EU59], SEQ ID NO: 180 [iproSav T167:mTth:EU59], SEQ ID NO: 181 [iproSav S196:mTth:EU59], SEQ ID NO: 182 [iproSav S208:mTth: EU59], SEQ ID NO: 183 [iproSav S239:mTth:EU59], SEQ ID NO: 184 [iproSav T243:mTth:EU59], SEQ ID NO: 185 [iproSav S269:mTth:EU59], SEQ ID NO: 186 [iproSav T285:mTth:EU59], SEQ ID NO: 187 [iproSav S293:mTth: EU59], SEQ ID NO: 188 [iproSav S317:mTth:EU59], SEQ ID NO: 189 [iproSav T318:mTth:EU59], SEQ ID NO: 190 [iproSav T329:mTth:EU59], SEQ ID NO: 209 [iproSavS135:mTth:O59_1], SEQ ID NO: 210 [iproSavS135: mTth:O59_2], SEQ ID NO: 211 [iproSavS135:mTth: O59_3], SEQ ID NO: 212 [iproSavS135:mTth:O59_4], SEQ ID NO: 213 [iproSavS135:mTth:O59_5], SEQ ID NO: 214 [iproSavS135:mTth:O59_6], SEQ ID NO: 215 [iproSavS317:Hwa:O59_1], SEQ ID NO: 216 [iproSavS317: Hwa:O59_2], SEQ ID NO: 217 [iproSavS317:Hwa:O59_3], SEQ ID NO: 218 [iproSavS317:Hwa:O59_4], SEQ ID NO: 219 [iproSavS317:Hwa:O59_5], SEQ ID NO: 220 [iproSavS317:Hwa:O59_6], SEQ ID NO; 221 [iproSavS317: Hwa:O59_7], SEQ ID NO: 222 [iproSavS317:Hwa:O59_8], SEQ ID NO: 223 [iproSavS317:Hwa:O59_9], SEQ ID NO: 233 [iproSavS135: mTth:P77Cd], SEQ ID NO: 234 [iproSavS269: mTth:P77Cd], SEQ ID NO: 235 [iproSavS293: mTth:P77Cd], SEQ ID NO: 236 [iproSavS317: mTth: P77Cd], SEQ ID NO: 237 [iproSavS312:mVMA-c:P77Cd], and SEQ ID NO: 238 [iproSavS326:mVMA-c:P77Cd].

12. An expression cassette comprising a nucleic acid encoding a multiprotein unit, the multiprotein unit comprising i) a modified intein having a first protein and an intein, and ii) a second protein, wherein the first protein is fused internally to the intein, the modified intein is fused internally to the second protein, and the modified intein is capable of effecting splicing of the multiprotein unit.

13. The expression cassette of embodiment 12, wherein the nucleic acid is operably connected to a promoter.

14. The expression cassette of any one or more of embodiments 12-13, wherein at least one of the first protein or the second protein is selected from the group consisting of: a protease, a phytase, an amylase, an invertase, a xylanase, an endoglucanase, an exoglucanase, a feruloyl esterase, a lipase, and a cellulase.

15. The expression cassette of any one or more of embodiments 12-14, wherein the protein selected as the first protein differs from the protein selected as the second protein.

16. The expression cassette of any one or more of embodiments 12-15, wherein the intein is selected from the group consisting of: mTth, Pho_RadA, Tko_RadA, Sce_VMA, mVMA, Pab_Lon, and Hwa_MCM-1.

17. The expression cassette of any one or more of embodiments 12-16, wherein the modified intein is inducible to cause splicing of the multiprotein unit by exposure of the multiprotein unit to an induction condition.

18. The expression cassette of any one or more of embodiments 12-17, wherein the induction condition is at least one condition selected from the group consisting of: an induction temperature, an induction pH, an induction light, an induction compound, an induction concentration of a compound, and an induction concentration of an ion.

19. The expression cassette of any one or more of embodiments 12-16, wherein the modified intein splices spontaneously.

20. The expression cassette of any one or more of embodiments 12-19, wherein a nucleic acid sequence encoding at least one of the first protein or the second protein has at least 90% identity to a reference sequence selected from the group consisting of: SEQ ID NO: 58 [P29600], SEQ ID NO: 59[P33558], SEQ ID NO: 60 [Q7WUM6; AAQ], SEQ ID NO: 61[P77853], SEQ ID NO: 62 [P77853Cd], SEQ ID NO: 63[EU591743], SEQ ID NO: 64 [O77044], SEQ ID NO: 65[O59952], SEQ ID NO: 207 [proSavinase], SEQ ID NO: 208 [Savinase catalytic domain].

21. The expression cassette of any one or more of embodiments 12-18 and 20, wherein a nucleic acid sequence encoding the intein has at least 90% identity to a reference sequence selected from the group consisting of: SEQ ID NO: 66 [mTth], SEQ ID NO: 67[Pho_RadA], SEQ ID NO: 68[Tko_RadA], SEQ ID NO: 69[SceVMA], SEQ ID NO: 70[Pab_Lon], SEQ ID NO: 74[mVMA], and SEQ ID NO: 206 [Hwa_MCM-1].

22. The expression cassette of any one or more of embodiments 12-18 and 20-21, wherein a nucleic acid sequence encoding the modified intein has at least 90% identity to a reference sequence selected from the group consisting of: SEQ ID NO: 71[mTth:EU59], SEQ ID NO: 72[Pho_RadA:EU59], SEQ ID NO: 73 [Tko_RadA:EU59], SEQ ID NO: 75 mVMA:P77Cd], SEQ ID NO: 119 [Hwa: O59-1], SEQ ID NO:120 [Hwa: O59-2], SEQ ID NO:121 [Hwa: O59-3], SEQ ID NO:122 [Hwa: O59-4], SEQ ID NO: 123 [Hwa: O59-5], SEQ ID NO: 124 [Hwa: O59-6], SEQ ID NO:125 [Hwa: O59-7], SEQ ID NO:126 [Hwa: O59-8], SEQ ID NO:127 [Hwa: O59-9], SEQ ID NO:128 [mTth: O59_1], SEQ ID NO: 129 [mTth: O59_2], SEQ ID NO:130 [mTth: O59_3], SEQ ID NO:131 [mTth: O59_4], SEQ ID NO:132 [mTth: O59_5], SEQ ID NO:133 [mTth: O59_6], and SEQ ID NO: 225 [mTth:P77Cd].

23. The expression cassette of any one or more of embodiments 12-18 and 20-22, wherein a nucleic acid sequence encoding the multiprotein unit has at least 90% identity to a reference sequence selected from the group consisting of: SEQ ID NO: 76 [NtEGS109:mTth:EU59], SEQ ID NO: 77 [NtEGT155:mTth:EU59], SEQ ID NO: 78 [NtEGS255:mTth:EU59], SEQ ID NO: 79 [NtEGS325: mTth:EU59], SEQ ID NO: 80 [NtEGC348:mTth:EU59], SEQ ID NO: 81 [NtEGS352:mTth:EU59], SEQ ID NO: 82 [NtEGS364:mTth:EU59], SEQ ID NO: 83 [NtEGT376: mTth:EU59], SEQ ID NO: 84 [NtEGS379:mTth:EU59], SEQ ID NO: 85 [P33S231:mTth:EU59] SEQ ID NO: 86 [P33S235:mTth:EU59], SEQ ID NO: 87 [P33S303:mTth: EU59], SEQ ID NO: 88 [P33S318:mTth:EU59], SEQ ID NO: 89 [AAQS121:mTth:EU59], SEQ ID NO: 90 [AAQS138:mTth:EU59], SEQ ID NO: 91 [AAQS140: mTth:EU59], SEQ ID NO: 92 [AAQS146:mTth:EU59], SEQ ID NO: 93 [AAQS179:mTth:EU59], SEQ ID NO: 94 [AAQS187:mTth:EU59], SEQ ID NO: 95 [AAQS222: mTth:EU59], SEQ ID NO: 96 [AAQS249:mTth:EU59], SEQ ID NO: 97 [AAQS251:mTth:EU59], SEQ ID NO: 98 [NtEGS352:mTth-c:EU59], SEQ ID NO: 99 [NtEGS364: mTth-c:EU59], SEQ ID NO: 100 [NtEGS149:Pho_RadA: EU59], SEQ ID NO: 101 [NtEGT179:Pho_RadA:EU59], SEQ ID NO: 102 [NtEGT200:Pho_RadA:EU59], SEQ ID NO: 103 [NtEGS352:Pho_RadA:EU59], SEQ ID NO: 104 [NtEGS149:Tko_RadA:EU59], SEQ ID NO: 105 [NtEGT179:Tko_RadA:EU59], SEQ ID NO: 106 [NtEGT200:Tko_RadA:EU59], SEQ ID NO: 107 [NtEGS352:Tko_RadA:EU59], SEQ ID NO: 108 [iproSavS135:mVMA:P77Cd], SEQ ID NO: 109 [iproSavS265: mVMA:P77Cd], SEQ ID NO: 110 [iproSavS269:mVMA: P77Cd], SEQ ID NO: 111 [iproSavS293:mVMA:P77Cd], SEQ ID NO: 112 [iproSavS312:mVMA:P77Cd], SEQ ID NO: 113 [iproSavS317:mVMA:P77Cd], SEQ ID NO: 114 [iproSavS326:mVMA:P77Cd], SEQ ID NO: 150 [iproSav S46:mTth:EU59], SEQ ID NO: 151 [iproSav S62:mTth: EU59], SEQ ID NO: 152 [iproSav T47:mTth:EU59], SEQ ID NO: 153 [iproSav S86:mTth:EU59], SEQ ID NO: 154 [iproSav S100:mTth:EU59], SEQ ID NO: 155 [iproSav T109:mTth:EU59], SEQ ID NO: 156 [iproSav S135:mTth: EU59], SEQ ID NO: 157 [iproSav T148:mTth:EU59], SEQ ID NO: 158 [iproSav S166:mTth:EU59], SEQ ID NO: 159

[iproSav T167:mTth:EU59], SEQ ID NO: 160 [iproSav S196:mTth:EU59], SEQ ID NO: 161 [iproSav S208:mTth: EU59], SEQ ID NO: 162 [iproSav S239:mTth:EU59], SEQ ID NO: 163 [iproSav T243:mTth:EU59], SEQ ID NO: 164 [iproSav S269:mTth:EU59], SEQ ID NO: 165 [iproSav T285:mTth:EU59], SEQ ID NO: 166 [iproSav S293:mTth: EU59], SEQ ID NO: 167 [iproSav S317:mTth:EU59], SEQ ID NO: 168 [iproSav T318:mTth:EU59], SEQ ID NO: 169 [iproSav T329:mTth:EU59], SEQ ID NO: 191 [iproSavS135:mTth:O59_1], SEQ ID NO: 192 [iproSavS135: mTth:O59_2], SEQ ID NO: 193 [iproSavS135:mTth:O59_3], SEQ ID NO: 194 [iproSavS135:mTth:O59_4], SEQ ID NO: 195 [iproSavS135:mTth:O59_5], SEQ ID NO: 196 [iproSavS135:mTth:O59_6], SEQ ID NO: 197 [iproSavS317:Hwa:O59_1], SEQ ID NO: 198 [iproSavS317: Hwa:O59_2], SEQ ID NO: 199 [iproSavS317:Hwa:O59_3], SEQ ID NO: 200 [iproSavS317:Hwa:O59_4], SEQ ID NO: 201 [iproSavS317:Hwa:O59_5], SEQ ID NO: 202 [iproSavS317:Hwa:O59_6], SEQ ID NO; 203 [iproSavS317: Hwa:O59_7], SEQ ID NO: 204 [iproSavS317:Hwa:O59_8], SEQ ID NO: 205 [iproSavS317:Hwa:O59_9], SEQ ID NO: 226 [iproSavS135: mTth:P77Cd], SEQ ID NO: 227 [iproSavS269: mTth:P77Cd], SEQ ID NO: 228 [iproSavS293: mTth:P77Cd], SEQ ID NO: 229 [iproSavS317: mTth: P77Cd], SEQ ID NO: 230 [iproSavS312:mVMA-c:P77Cd], and SEQ ID NO: 231 [iproSavS326:mVMA-c:P77Cd].

24. A vector comprising the expression cassette of any one or more embodiments 12-23.

25. The vector of embodiment 24 comprising a nucleic acid sequence having at least 90% identity to a reference sequence selected from the group consisting of: SEQ ID NO: 115 [pAG4535], SEQ ID NO: 116 [pAG4536], SEQ ID NO: 117 [pAG4537], and SEQ ID NO: 118 [pAG4538].

26. A host expressing a multiprotein unit comprising i) a modified intein including a first protein and an intein, and ii) a second protein, wherein the first protein is fused internally to the intein, the modified intein is fused internally to the second protein, and the modified intein is capable of effecting splicing of the multiprotein unit.

27. The host of embodiment 26, wherein at least one of the first protein or the second protein is selected from the group consisting of: a protease, a phytase, an amylase, an invertase, a xylanase, an endoglucanase, an exoglucanase, a feruloyl esterase, a lipase, and a cellulase.

28. The host of any one or more of embodiments 26-27, wherein the protein selected as the first protein differs from the protein selected as the second protein.

29. The host of any one or more of embodiments 26-28, wherein the intein is selected from the group consisting of: mTth, Pho_RadA, Tko_RadA, Sce_VMA, mVMA, Pab_Lon, and Hwa_MCM-1.

30. The host of any one or more of embodiments 26-29, wherein the modified intein is inducible to cause splicing of the multiprotein unit by exposure of the multiprotein unit to an induction condition.

31. The host of any one or more of embodiments 26-30, wherein the induction condition is at least one condition selected from the group consisting of: an induction temperature, an induction pH, an induction light, an induction compound, an induction concentration of a compound, and an induction concentration of an ion.

32. The host of any one or more of embodiments 26-29, wherein the modified intein splices spontaneously.

33. The host of any one or more of embodiments 26-32, wherein a sequence of at least one of the first protein or the second protein has at least 90% identity to a reference sequence selected from the group consisting of: SEQ ID NO: 1[P29600], SEQ ID NO: 2[P33558], SEQ ID NO: 3[Q7WUM6; AAQ], SEQ ID NO: 4[P77853], SEQ ID NO: 5 [P77853Cd], SEQ ID NO: 6[EU591743], SEQ ID NO: 7 [O77044; NtEG], SEQ ID NO: 8[O59952], SEQ ID NO: 17 [Savinase catalytic domain], and SEQ ID NO: 149 [pro-Savinase].

34. The host of any one or more of embodiments 26-31 and 32-33, wherein a sequence of the intein has at least 90% identity to a reference sequence selected from the group consisting of: SEQ ID NO: 9 [mTth], SEQ ID NO: 10 [Pho_RadA], SEQ ID NO: 11 [Tko_RadA], SEQ ID NO: 12 [SceVMA], SEQ ID NO: 13[Pab_Lon], SEQ ID NO: 17[mVMA], and SEQ ID NO: 224 [Hwa_MCM-1].

35. The host of any one or more of embodiments 26-31 and 32-34, wherein a sequence of the modified intein has at least 90% identity to a reference sequence selected from the group consisting of: SEQ ID NO: 14[mTth:EU59], SEQ ID NO: 15 [Pho_RadA:EU59], SEQ ID NO: 16 [Tko_RadA: EU59], SEQ ID NO: 18 [Sce_VMA:P77Cd], SEQ ID NO: 134 [Hwa-O59-1], SEQ ID NO:135 [Hwa-O59-2], SEQ ID NO:136 [Hwa-O59-3], SEQ ID NO:137 [Hwa-O59-4], SEQ ID NO: 138 [Hwa-O59-5], SEQ ID NO: 139 [Hwa-O59-6], SEQ ID NO:140[Hwa-O59-7], SEQ ID NO:141[Hwa-O59-8], SEQ ID NO:142 [Hwa-O59-9], SEQ ID NO:143 [mTth O59_1], SEQ ID NO: 144 [mTth O59_2], SEQ ID NO:145 [mTth O59_3], SEQ ID NO:146 [mTth O59_4], SEQ ID NO:147 [mTth O59_5], SEQ ID NO:148 [mTth O59_6], and SEQ ID NO: 232 [mTth:P77Cd].

36. The host of any one or more of embodiments 26-31 and 32-35, wherein a sequence of the multiprotein unit has at least 90% identity to a reference sequence selected from the group consisting of: SEQ ID NO: 19 [NtEGS109:mTth: EU59], SEQ ID NO: 20 [NtEGT155:mTth:EU59], SEQ ID NO: 21 [NtEGS255:mTth:EU59], SEQ ID NO: 22 [NtEGS325:mTth:EU59], SEQ ID NO: 23 [NtEGC348: mTth:EU59], SEQ ID NO: 24 [NtEGS352:mTth:EU59], SEQ ID NO: 25 [NtEGS364:mTth:EU59], SEQ ID NO: 26 [NtEGT376:mTth:EU59], SEQ ID NO: 27 [NtEGS379: mTth:EU59], SEQ ID NO: 28 [P33S231:mTth:EU59] SEQ ID NO: 29 [P33S235:mTth:EU59], SEQ ID NO: 30 [P33S303:mTth:EU59], SEQ ID NO: 31 [P33S318:mTth: EU59], SEQ ID NO: 32 [AAQS121:mTtH:EU59], SEQ ID NO: 33 [AAQS138:mTtH:EU59], SEQ ID NO: 34 [AAQS140:mTtH:EU59], SEQ ID NO: 35 [AAQS146: mTtH:EU59], SEQ ID NO: 36 [AAQS179:mTtH:EU59], SEQ ID NO: 37 [AAQS187:mTtH:EU59], SEQ ID NO: 38 [AAQS222:mTtH:EU59], SEQ ID NO: 39 [AAQS249: mTtH:EU59], SEQ ID NO: 40 [AAQS251:mTtH:EU59], SEQ ID NO: 41 [NtEGS352:mTth-c:EU59], SEQ ID NO: 42 [NtEGS364:mTth-c:EU59], SEQ ID NO: 43 [NtEGS149: Pho_RadA:EU59], SEQ ID NO: 44 [NtEGT179: Pho_RadA: EU59], SEQ ID NO: 45 [NtEGT200: Pho_RadA: EU59], SEQ ID NO: 46 [NtEGS352: Pho_RadA: EU59], SEQ ID NO: 47 [NtEGS149: Tko_RadA: EU59], SEQ ID NO: 48 [NtEGT179: Tko_RadA: EU59], SEQ ID NO: 49 [NtEGT200: Tko_RadA: EU59], SEQ ID NO: 50 [NtEGS352: Tko_RadA: EU59], SEQ ID NO: 51 [iproSavS135: mVMA: P77Cd], SEQ ID NO: 52 [iproSavS265: mVMA:P77Cd], SEQ ID NO: 53 [iproSavS269:mVMA: P77Cd], SEQ ID NO: 54 [iproSavS293: mVMA: P77Cd], SEQ ID NO: 55 [iproSavS312: mVMA: P77Cd], SEQ ID NO: 56 [iproSavS317: mVMA: P77Cd], SEQ ID NO: 57 [iproSavS326: mVMA: P77Cd], SEQ ID NO: 171[iproSav S46:mTth:EU59], SEQ ID NO: 172 [iproSav S62:mTth: EU59], SEQ ID NO: 173 [iproSav T47:mTth:EU59], SEQ ID NO: 174 [iproSav S86:mTth:EU59], SEQ ID NO: 175 [iproSav S100:mTth:EU59], SEQ ID NO: 176 [iproSav T109:mTth:EU59], SEQ ID NO: 177 [iproSav S135:mTth: EU59], SEQ ID NO: 178 [iproSav T148:mTth:EU59], SEQ ID NO: 179 [iproSav S166:mTth:EU59], SEQ ID NO: 180 [iproSav T167:mTth:EU59], SEQ ID NO: 181 [iproSav S196:mTth:EU59], SEQ ID NO: 182 [iproSav S208:mTth: EU59], SEQ ID NO: 183 [iproSav S239:mTth:EU59], SEQ ID NO: 184 [iproSav T243:mTth:EU59], SEQ ID NO: 185 [iproSav 5269:mTth:EU59], SEQ ID NO: 186 [iproSav T285:mTth:EU59], SEQ ID NO: 187 [iproSav S293:mTth: EU59], SEQ ID NO: 188 [iproSav S317:mTth:EU59], SEQ ID NO: 189 [iproSav T318:mTth:EU59], SEQ ID NO: 190 [iproSav T329:mTth:EU59], SEQ ID NO: 209 [iproSavS135:mTth:O59_1], SEQ ID NO: 210 [iproSavS135: mTth:O59_2], SEQ ID NO: 211 [iproSavS135:mTth: O59_3], SEQ ID NO: 212 [iproSavS135:mTth:O59_4], SEQ ID NO: 213 [iproSavS135:mTth:O59_5], SEQ ID NO: 214 [iproSavS135:mTth:O59_6], SEQ ID NO: 215 [iproSavS317:Hwa:O59_1], SEQ ID NO: 216 [iproSavS317: Hwa:O59_2], SEQ ID NO: 217 [iproSavS317:Hwa:O59_3], SEQ ID NO: 218 [iproSavS317:Hwa:O59_4], SEQ ID NO: 219 [iproSavS317:Hwa:O59_5], SEQ ID NO: 220 [iproSavS317:Hwa:O59_6], SEQ ID NO; 221 [iproSavS317: Hwa:O59_7], SEQ ID NO: 222 [iproSavS317:Hwa:O59_8], SEQ ID NO: 223 [iproSavS317:Hwa:O59_9], SEQ ID NO: 233 [iproSavS135: mTth:P77Cd], SEQ ID NO: 234 [iproSavS269: mTth:P77Cd], SEQ ID NO: 235 [iproSavS293: mTth:P77Cd], SEQ ID NO: 236 [iproSavS317: mTth: P77Cd], SEQ ID NO: 237 [iproSavS312:mVMA-c:P77Cd], and SEQ ID NO: 238 [iproSavS326:mVMA-c:P77Cd].

37. The host of any one or more of embodiments 26-36, wherein the host organism is selected from the group consisting of: a plant, a yeast, a bacterium, a mammalian cell, an insect cell, and a phage.

38. A host comprising the multiprotein unit of any one or more of embodiments 1-11 or the expression cassette of any one or more of embodiments 12-23

39. A method for producing multiple proteins in a host comprising: contacting a host cell with a transformation vector comprising the expression cassette that includes a nucleic acid encoding a multiprotein unit of any one or more of embodiments 1-11;
selecting the host cell that includes the expression cassette and expresses the multiprotein unit.

40. The method of embodiment 39, wherein the multiprotein unit is spliced spontaneously.

41. The method of any one or more of embodiments 39-40 further comprising inducing splicing of the multiprotein unit by exposure of the multiprotein unit to an induction condition.

42. The method of any one or more of embodiments 39-41, wherein the induction condition is at least one condition selected from the group consisting of: an induction temperature, an induction pH, an induction light, an induction compound, an induction concentration of a compound, and an induction concentration of an ion.

43. A method for regulating expression of at least one protein comprising allowing a modified intein in a multiprotein unit to splice the multiprotein unit, wherein the multiprotein unit includes i) a modified intein having a first protein and an intein, and ii) a second protein, wherein the first protein is fused internally to the intein, the modified intein is fused internally to the second protein in such a position as to substantially reduce or inhibit the activity of the second protein, and the modified intein is capable of effecting splicing of the multiprotein unit.

44. The method of embodiment 43, further comprising expressing a multiprotein unit in a host.

45. The method of any one or more of embodiments 43-44, wherein the intein is fused to the first protein in such a position as to substantially reduce or inhibit the activity of the first protein.

46. The method of any one or more of embodiments 43-45, wherein the modified intein causes spontaneous splicing of the multiprotein unit. 47. The method of any one or more of embodiments 43-46, wherein the modified intein is inducible to cause splicing of the multiprotein unit, and allowing the modified intein to splice the multiprotein unit by exposing the multiprotein unit to an induction condition.

48. The method of any one or more of embodiments 43-47, wherein the induction condition is at least one condition selected from the group consisting of: an induction temperature, an induction pH, an induction light, an induction compound, an induction concentration of a compound, and an induction concentration of an ion.

49. The method of any one or more of embodiments 43-48, wherein the activity of the first protein is restored upon splicing of the multiprotein unit.

50. The method of any one or more of embodiments 43-49, wherein the activity of the second protein is restored upon splicing of the multiprotein unit.

Further embodiments herein may be formed by supplementing an embodiment with one or more element from any one or more other embodiment herein, and/or substituting one or more element from one embodiment with one or more element from one or more other embodiment herein.

EXAMPLES

The following non-limiting examples are provided to illustrate particular embodiments. The embodiments throughout may be supplemented with one or more detail from one or more example below, and/or one or more element from an embodiment may be substituted with one or more detail from one or more example below.

Example 1. Materials and Methods

Creation of Modified Inteins

The nucleotide sequence of the intein from *Thermus thermophilus* (Tth) was corn codon optimized for plant expression, and synthesized by Codon Devices, Inc. The Tth sequence was amplified by the PCR reaction to generate two fragments corresponding to N-terminal and C-terminal parts of the Tth intein, with each part containing a linker that overlaps with the other part, thereby fusing the N-terminal and C-terminal parts of the Tth intein without the intervening homing endonuclease domain. The linker is an eight amino acid peptide designed to provide flexibility for the adjacent peptide to fold. PCR assembling of the two fragments created the miniature Tth (mTth) that had an eight amino acid linker in place of the homing endonuclease domain. The coding sequence of the first protein, EU591743 (also named EU59 herein) xylanase, was inserted into mTth before, within or after the linker by overlapping PCR to create genetic constructs. These constructs were cloned into the EcoRI and XhoI sites of the Lambda ZAPII vector (Agilent Technologies) and expressed in XL1 Blue cells which were plated onto NZY agar plates containing AZCL-xylan substrate (0.2% w/v) and 2.5 mM IPTG. Xylanase activity was scored as blue halo around the plaques, with low activity being small halo and high activity being large halo. Based on the measured xylanase activity, one of the three constructs, in which EU59 was inserted before the linker, was chosen for use as modified mTth:EU59 intein [SEQ ID NO: 71].

Similarly, EU59 xylanase was inserted into other inteins, including Pho_RadA and Tko_RadA which were inserted into a second protein NtEG (see Example 7). Besides EU59 xylanase, other first proteins were also inserted into various inteins. The catalytic domain of XynB (Accession number P77853), named P77Cd, was inserted into mTth to generate mTth:P77Cd intein, and SceVMA, to generate mVMA: P77Cd intein. Creation and use of mTth:P77Cd intein and mVMA:P77Cd intein were described in Example 11. The first protein also included the lipase (Accession number O59953) which was inserted into mTth to generate the mTth:O59 intein and into Hwa_MCM1 to generate Hwa: O59 intein. Creation and use of mTth:O59 intein and Hwa: O59 intein were detailed in Example 12.

Insertion of Modified mTth:EU59 Intein into Target Enzymes

The modified mTth:EU59 intein was inserted into several second proteins, such as xylanase P33558 (also named P33) [SEQ ID NO: 2], xylanase AAQ01666 (also named AAQ) [SEQ ID NO: 3], cellulase NtEG [{SEQ ID NO: 7}, or protease (Accession number P29600, also named Savinase) [SEQ ID NO: 1], at 5'-side of selected cysteine, serine, or threonine codons using overlapping PCR. Briefly, three pieces of DNA representing the N-extein (N) and C-extein (C) of target enzymes, and the mTth:EU59 intein (I), were PCR amplified (Phusion Hot Start, New England Biolabs) using primers that overlapped the adjacent DNA fragments by 20 base pairs. These individual pieces of DNA (N, I and C) were resolved on the Seakem agarose gel (Lonza). Column-purified (Qiagen) fragments were assembled in a single PCR reaction with KAPA HiFi HotStart (KAPA Biosystems) using an N-extein sense primer and a C-extein antisense primer to generate intein-modified xylanase or cellulase gene constructs (referred to herein as a NIC). Each N-extein sense primer included an EcoRI restriction site and each C-extein antisense primer included an XhoI restriction site. NICs were gel purified using a QIAquick Gel Extraction kit (Qiagen), digested with EcoRI and XhoI restriction enzymes (New England Biolabs), the resulting DNA fragments were gel purified using a QIAquick Gel Extraction kit (Qiagen). The purified NIC digest was ligated into the EcoRI and XhoI sites of the pre-cut lambda ZAP®II vector and packaged into phage with a package extract following the manufacturer's procedure (Agilent Technologies).

Diagnostic Plate Screening for Xylanase Activity

Phage-infected XL1-Blue MRF' cells were plated (2-4× 10$^3$ pfu/150 mm plate) on NZY agar plates with NZY top agarose containing 0.2% AZCL-xylan substrate and 2.5 mM IPTG. After overnight incubation at 37° C., plaques were scored for spontaneous xylanase activity (manifested as blue color development in and around the plaques), and then plates were incubated either in 70° C. or 20° C. to identify plaques expressing a thermoregulated intein-modified xylanase. Depending on the insertion site, the mTth:EU59 intein showed different enzyme activity due to splicing and the plaques were scored on the diagnostic agar plates according to their activity, as evidenced by color development (plaque "phenotype") on NZY agar containing AZCL-xylan, which turns blue when exposed to an active xylanase.

Candidate plaques that showed either spontaneous or inducible blue color development (referred to herein as a "thermoregulated phenotype") were isolated and purified. Because high temperatures not only caused inteins to splice but also phage titer to drop, heat treatment of agar plates with plaques was usually performed between 60-70° C. for less than 6 hours. On the other hand, cold treatment was usually done between 20-28° C. overnight. Due to the high plaque density in the initial library screening, candidate plaques were often in close contact with the neighboring plaques. To purify a candidate plaque, the agar plug that contains a candidate plaque and the neighboring plaques was picked with a glass Pasteur pipette and put into 200 µL SM buffer to allow phage particles to defuse into the solution. A small aliquot (5 µL) of phage was serially diluted up to 10,000 times (four serials of 10× dilutions) in 50 µL SM buffer. Five microliters phage from each dilution were mixed with 50 µL fresh XL1 blue E. coli cells (OD590 nm=0.5) and incubated for 15 min at 37° C. The infected cells from each of the four dilutions were mixed with 700 µL NZY top agarose (50° C.) containing IPTG (2.5 mM; isopropyithio-β-galactoside) and AZCL-xylan (0.2% w/v) and spread in a quadrant of a 10 mm NZY plate. Plates were incubated overnight at 37° C. to allow plaques to fully develop, scored for spontaneous splicing under the incubation conditions, and then treated at 70° C. for approximately 2-4 hrs or 20° C. overnight to screen for temperature induced intein splicing. A single plaque that showed the thermoregulated phenotype was isolated as a purified candidate plaque. Each purified candidate plaque was similarly diluted and plated onto three NZY plates with IPTG and xylan substrate as described above, but treated separately at 20° C., 37° C., 50° C. or 70° C. for 2~6 hrs after overnight incubation at 37° C. Candidates with the validated thermoregulated phenotype were individually phagemid rescued into SOLR E. coli cells, following the manufacture's procedures (Agilent Technologies). Candidates were validated with a cell lysate-based activity assay (described below), Western Blot, and DNA Sequence Analysis.

Cell Culture, Lysate Preparation and Enzymatic Assay

E. coli SOLR cells expressing an unmodified cellulase or xylanase, an intein-modified cellulase or xylanases along with cells transformed with pBluescript vector were inoculated from individual colonies and grown in 96-well plates containing 1 mL of AIM (Novagen) supplemented with Carbenicillin (100 mg/L) at 37° C. for 10 hrs and then at 30° C. for 6 hrs in a shaking incubator (New Brunswick), at 900 rpm. Cells were harvested at 4000 rcf for 10 min, pellets were resuspended in 100 µL lysis buffer containing 200 mM sodium phosphate (pH 6.5), 1× FastBreak Lysis Buffer™ (Promega), and 0.2 µL DNase/mL Benzonase nuclease (Novagen). Additional 400 µL 200 mM sodium phosphate buffer (pH6.5) was added to each lysate. Seventy microliters lysate was transferred to 384-well plates, heat treated at 25° C. 65° C. for up to 16 hrs and cooled to 25° C. All samples were mixed with 0.2% (w/v) fine ground solid substrate of AZCL-xylan oat (Megazyme, for EU59- or P77cd-modified inteins) or wheat beta glucan (Megazyme, for NtEG) or 500 µM N-succinyl-Ala-Ala-Pro-Phe-pNa (Sigma-Aldrich, for Savinase) and incubated at 37° C. for approximately 1.0 hr. Reaction samples were vortexed, centrifuged at 4,000 rcf for 7 min, and 50 µL aliquots of the supernatant were measured for absorbance at 590 nm on a Paradigm microplate reader. Average activity and standard deviations were calculated from assays of extracts from 8-12 independently inoculated replicate cultures.

Enzymatic Assay for Intein-Modified Savinase

For intein-modified Savinases, cultures were grown in the LB medium overnight at 30° C., 900 rpm. IPTG was added at a final concentration of 2.5 mM to an overnight fresh culture which was diluted to OD600=0.6 and cultured at 30° C., 250 rpm for 4 hrs. Cells were harvested at 4000 rcf for 10 min, pellets were resuspended in 100 µL lysis buffer containing BR buffer (pH 9.0), 1× FastBreak Lysis Buffer™ (Promega), and 0.2 µL DNase/mL Benzonase nuclease (Novagen). Additional 400 µL BR buffer (pH9.0) was added to each lysate.

The substrate for the Savinase enzyme assay is the chromogenic peptide substrate N-Succinyl-Ala-Ala-Pro-Phe p-nitroanilide (Sigma-Aldrich). This substrate is highly specific for subtilisin-like enzymes (Davis et al., 1999) and it can support enzyme assays in bacterium suspensions (Bonifait et al., 2010). In a typical assay, 100 µL of lysate, or bacterium suspension is added to 20 µL of the chromogenic substrate N-succinyl-Ala-Ala-Pro-Phe-pNa (2 mg/mL in 50% dimethyl formamide), the reaction mixture is incubated at 37° C. for variable times and the release of pNA is quantified by measuring the absorbance at 415 nm (Bonifait et al., 2010). This protocol is easily adaptable through automation to support screening by performing high throughput protease activity assays. Proteolytic activity can also be measured by digestion of AZO-casien (Vazquez et al. 2004). Twenty microliters of lysate are incubated in 384-well plate with 20 µL of 1% (w/v) AZO-casein in Tris-HCl buffer (0.1 M, pH8.0) and 0.5 mM CaCl2 at 55° C. for 30 min. After stopping the reaction with 40 µL of 5% (w/v) trichloroacetic acid, reaction mixture is centrifuged and absorbance of supernatant was measured at 340 nm.

Western Blot

E. coli SOLR cells were grown, harvested and lysed as described above. Total cell lysate (50 µL) was transferred to a sterile centrifuge tube or PCR tube and heat treated at temperatures and hours as specified above. Heat treated samples were diluted by 5-fold using 1×PBS (137 mM NaCl, 2.7 mM KCl, 4.3 mM of $Na_2HPO_4$, and 1.47 mM of $KH_2PO_4$ adjusted to pH 7.4). Western blotting followed standard procedures. Antiserum against either the target enzymes (P33558, or NtEG) or an intein (EU59 reporter) was used.

Yeast Transformation and Growth Test

Yeast expression vector pSavi-Y 135/317 was generated by inserting pro-Savinase into p416 GALL vector and by introducing BamHI recognition sequence in savinase at S135 and S317 sites. It was constructed by gap-repair cloning of the pro-Savinase gene into p416 GALL downstream of GalL promoter, where expression of pro-Savinase is turned on by galactose and turned off by glucose. pSaviY135 carries pro-Savinase gene with BamHI recognition sequence at its S135 site, while pSaviY317 carries pro-Savinase gene with BamHI sequence at its S317 site. The vector DNA is routinely prepared from E. coli overnight cultures in LB (Luria-Bertani) medium containing ampicillin, according to QIAprep Spin Miniprep Kit Protocol (Qiagen).

For library construction, BamHI-linearized vector DNA was co-transformed with PCR amplified DNA from Unc-ERS_RIR1 and Sce_VMA inteins and transformants were plated on synthetic medium plates lacking Uracil (Ura⁻) but with glucose or galactose. Yeast strain BY4741 was used to demonstrate the phenotype of growth inhibition (cytotoxicity) conferred by heterologous expression of pro-Savinase gene, which was developed into a high throughput screening assay for Savinase activity resulting from intein splicing.

Yeast transformation is routinely carried out with the LiAc/SS carrier DNA/PEG method. Two µg of BamHI-linearized pSaviY135/317 and 6 µg of PCR-generated intein variants were mixed with 400 µL freshly made yeast BY4741 competent cells and delivered at 2.5 kV and 25 µF (typical time constant ranges from 3.0 to 4.5 milliseconds) in a GenePulser cuvette (0.2 cm gap). This electroporation method allows for efficient generation of large libraries with up to $4 \times 10^7$ variants.

Following electroporation, yeast transformation mix was plated out on Ura⁻ agar plates that contain 2% galactose (which turns ON the GalL promoter) and incubated at 30° C. for up to 3 days. Yeast cells carrying variants that constitutively splice at 30° C. will accumulate active Savinase, resulting in growth inhibition or host cell elimination. Consequently, the resulting sub-library is enriched for yeast transformants whose splicing is suppressed at 30° C. This procedure generally yields about 100 fold enrichment.

Savinase activity-associated yeast growth inhibition was developed into a cell-based selection assay, which was employed in the primary library screening to identify cold inducible iSavinase. Following library enrichment in 2% galactose, yeast transformants were individually picked as colonies and inoculated into 0.5 or 0.1 mL of Ura⁻ selection media containing 2% glucose. After incubation at 30° C. for 2 days, the saturated yeast culture ($OD_{600}$ 3~4) was sub-cultured (100 fold dilution) in Ura⁻ selection media containing 2% galactose, in 2 sets of 96- or 384-well plates, with one set incubated at 20° C. and the other set at 30° C. for up to 5 days. Cell growth was monitored daily by measuring $OD_{600}$. Throughout the test, an unmodified pro-Savinase and its mutant SavinaseH62A constructs were used as controls. Cells expressing unmodified pro-Savinase grew poorly at 20° C. and 30° C. and those expressing inactive H62A Savinase grew well at both temperatures. Yeast variants that grew normally at 30° C., similar to H62A expressing cells, yet very slowly at 20° C., similar to unmodified pro-Savinase, were scored as "positive". For verification purpose, positive clones were then cherry-picked and re-assessed for the growth phenotype at 20° C. and 37° C. Following verification, 54 clones of Unc-ERS_RIR1 variants and 60 clones of Sce_VMA variants were prioritized as "HITs" for further evaluation and lead candidate identification on a secondary (activity) assay. DNAs were prepared and submitted for sequencing analysis of mutant intein variants.

Lipase Activity Assay

Lipase expression constructs were transformed in E. coli and in yeast. Transformation, cell culture and lysate preparation followed procedures described above. Twenty microliter cell lysate was mixed with 100 µL Tris-HCl pH8.5, 60 µL $H_2O$ and 20 µL pNP substrate (4 mM 4-Nitrophenyl butyrate in 50 mM Tris-HCl pH 8.5), briefly mixed and incubated at 37° C. for 15 min. Reaction was stopped by clarification at 4500 rpm for 5 min. One hundred microliter supernatant was transferred to a flat bottom 96-well plate and absorbance measured at OD 415 nm.

Example 2. Design of Modified Inteins

Inteins contain conserved blocks critical for the splicing reaction. These blocks are usually located near the intein's N-terminal and C-terminal. While most mutations in these regions negatively impact intein splicing, other mutations in or adjacent to these blocks can actually improve splicing. Inteins also contain centrally located homing endonuclease domains (HEN) which recognize and cut specific target DNA sequence for their own propagation (FIG. 1). This endonuclease activity, however, is not required for intein splicing. Miniature inteins have been generated that lack the homing endonuclease domain yet still maintain the self splicing capacity.

Referring to FIG. 1, replacing the homing endonuclease domain of an intein with a functional enzyme (or the first gene of interest, GOI-1) may be used for at least the following applications: 1) to use the inserted enzymes as a reporter gene for intein splicing or cellular localization; 2) to use the inserted enzyme as a selection marker gene; and 3) to express a novel enzyme. Thus modified intein could then be inserted into the second gene of interest (GOI-2) encoding a target protein and may be used to regulate the activity of both target proteins or deliver two proteins from a single expression cassette. As a result, maturation of the second protein could be monitored by the activation of the reporter enzyme or be selected by the marker gene activity. Additionally, the modified intein could be used to stack multiple genes using a single set of regulatory elements such as a promoter and a terminator.

Example 3. mTth:EU59 Intein

Tth-HB27 DnaE-1 (Tth) intein from the thermophilic, non-pathogenic bacterium *Thermus thermophilus* was sequence aligned with its highly resembling and well studied homolog, RecA intein. This alignment identified the putative homing endonuclease (HEN) domain in the Tth intein, which was then deleted using a PCR approach. The newly generated intein, miniature Tth or mTth [SEQ ID NO: 10], contains a short linker sequence of 8 amino acids to increase the flexibility of its folding.

The nucleic acid encoding EU591743 xylanase (EU59) [SEQ ID NO: 63] was chosen as a gene of interest (GOI-1) as well as a reporter gene because of its thermostability, high specific activity and potential application in biomass degradation. To engineer an intein with xylanase activity, EU59 [SEQ ID NO: 6] was inserted into mTth [SEQ ID NO: 9] either before, within or after the linker and each expressed as a fusion protein in *E. coli* (FIG. 2A). Cell lysate from each construct was assayed for xylanase activity using AZCL-xylan substrate. The construct that showed thermostability and hydrolytic activity on xylan substrate comparable to wild type EU59 was identified for use as a modified intein. The resulting intein was inserted before threonine, serine and cysteine sites in cellulase NtEG, the enzyme encoded by the second gene of interest and resulted in the following constructs encoding intein modified cellulases: NtEGS109:mTth:EU59 [SEQ ID NO: 76], NtEGS155:mTth:EU59 [SEQ ID NO: 77], NtEGS255:mTth:EU59 [SEQ ID NO: 78], NtEGS325:mTth:EU59 [SEQ ID NO: 79], NtEGC348:mTth:EU59 [SEQ ID NO: 80], NtEGS352:mTth:EU59 [SEQ ID NO: 81], NtEGS364:mTth:EU59[SEQ ID NO: 82], NtEGT376:mTth:EU59[SEQ ID NO: 83], and NtEGS379:mTth:EU59[SEQ ID NO: 84].

The resulting multiprotein expression constructs was introduced into *E. coli* SOLR cells. Total cell lysate was prepared and evaluated for intein splicing by Western blot (FIG. 2B) or by enzymatic assay (FIG. 2C). FIGS. 2A and 2B show that the modified mTth:EU59 functions as an intein and could splice depending on the insertion site in NtEG.

Example 4. Intein-Modified P33558 Xylanase

The modified mTth:EU59 intein was used to engineer a thermoregulated xylanase P33558. The gene encoding mTth:EU59 intein [SEQ ID NO: 71] was inserted into the nucleic acid sequence encoding P33558 xylanase [SEQ ID NO: 62] in four sites prior the nucleic acids encoding the following amino acids: S231, S235, S303, and S318, to generate intein-modified P33558 xylanases: P33S231:mTth:EU59 [SEQ ID NO:85], P33S235:mTth:EU59 [SEQ ID NO:86], P33S303:mTth:EU59 [SEQ ID NO:87], and P33S318:mTth:EU59 [SEQ ID NO:88]. These constructs were cloned into lambda ZAPII vector and expressed in SOLR cells as described in Example 1.

*E. coli* cells expressing the intein-modified xylanases were grown in overnight cultures and cell lysates were prepared as described in Example 1. To test for temperature shift inducible splicing, aliquots of cell lysate were incubated separately at 37° C. and 60° C. for 4 hours, then proteins were resolved on SDS-PAGE gel and Western blotted using antibodies specific to xylanase EU59 (FIG. 3A) and xylanase P33558 (FIG. 3B). FIGS. 3A and 3B show Western blot of intein splicing. Positions of the intein-modified P33 xylanase (as precursor) and free mTth:EU59 inteins are marked at the left in FIG. 3A. Positions of the intein-modified xylanase (precursor) and P33 (as mature protein) are marked at the left in FIG. 3B. In both FIG. 3A and FIG. 3B, the two lanes indicated above each insertion sites are aliquots pretreated for 4 hrs at 37° C. (open rectangle) and 60° C. (filled rectangle). As shown in these figures, three of the four intein-modified xylanases with insertion at S231, S235, S303 showed splicing of the modified intein (FIG. 3A) and reconstitution of the disrupted P33558 (FIG. 3B) demonstrating that the modified mTth:EU59 functions as an intein.

Example 5. Intein-Modified AAQ01666 Xylanase

Figure 4A:
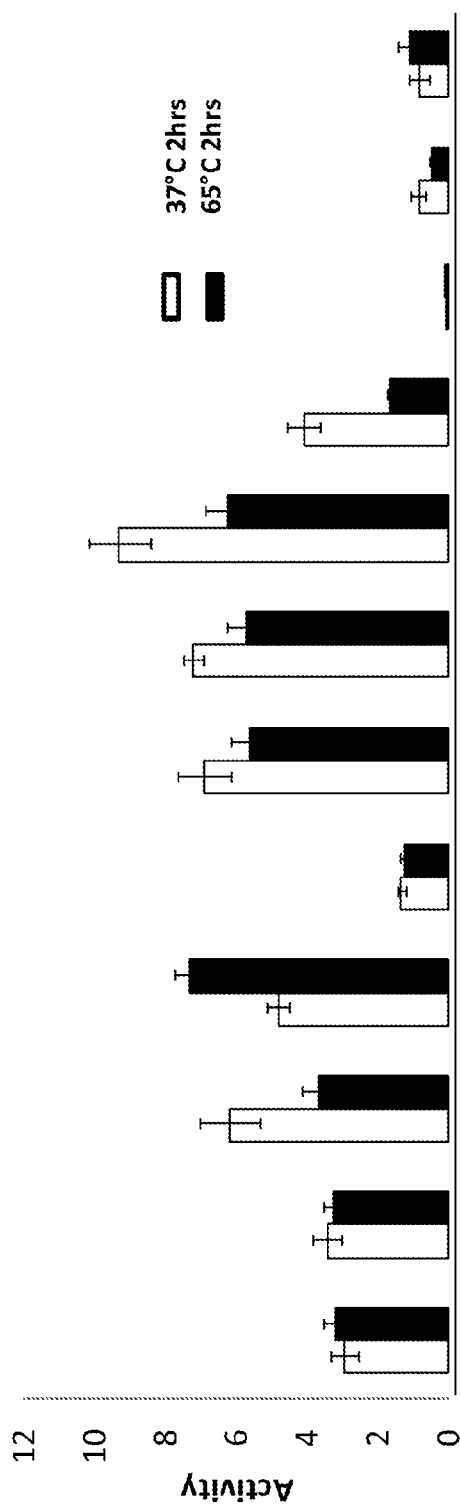
FIG. 4A illustrates xylanase activity of the mTth:EU59-modified AAQ01666 xylanase.
Figure 4B:
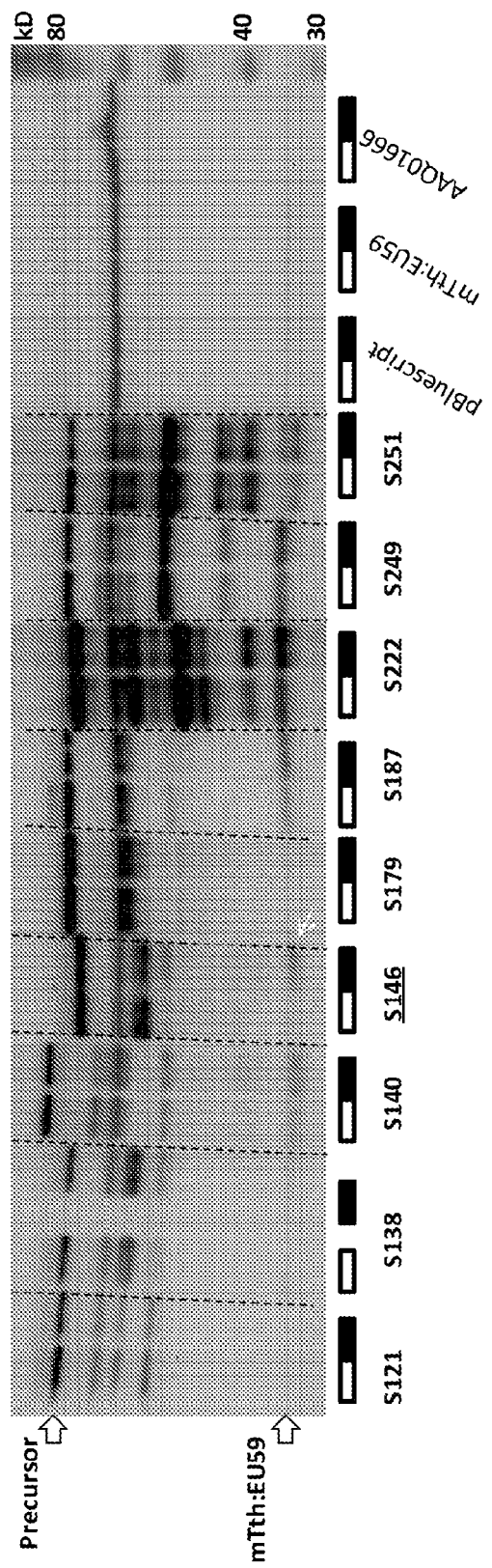
FIG. 4B illustrates mTth:EU59 splicing in xylanase AAQ01666 analyzed by Western blot using an EU59-specific antibody.
Figures 5A, 5B:
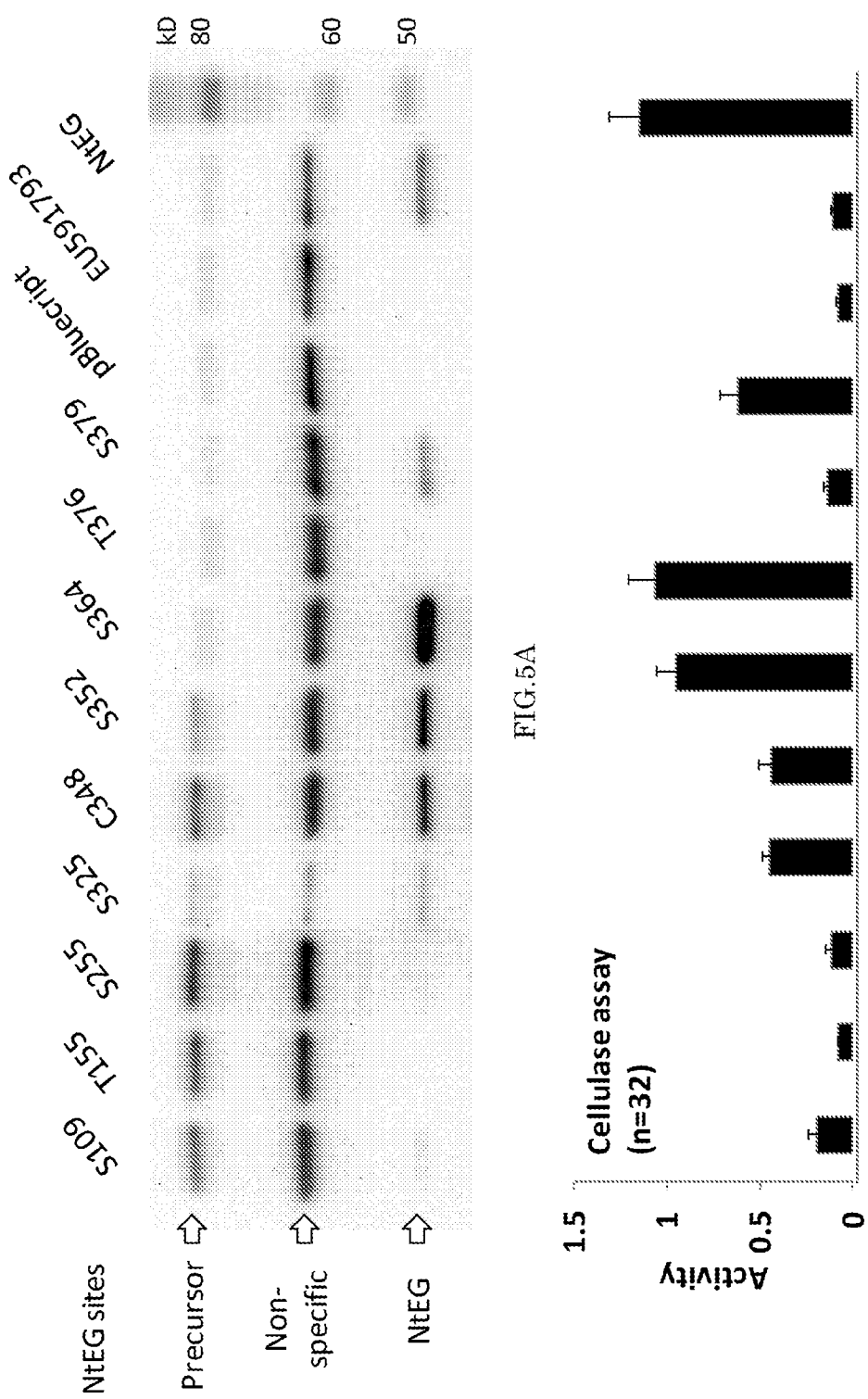
FIGS. 5A-5B illustrate that intein splicing leads to NtEG cellulase activation. Intein splicing was analyzed by Western blot using an NtEG-specific antibody.
Figure 6A:
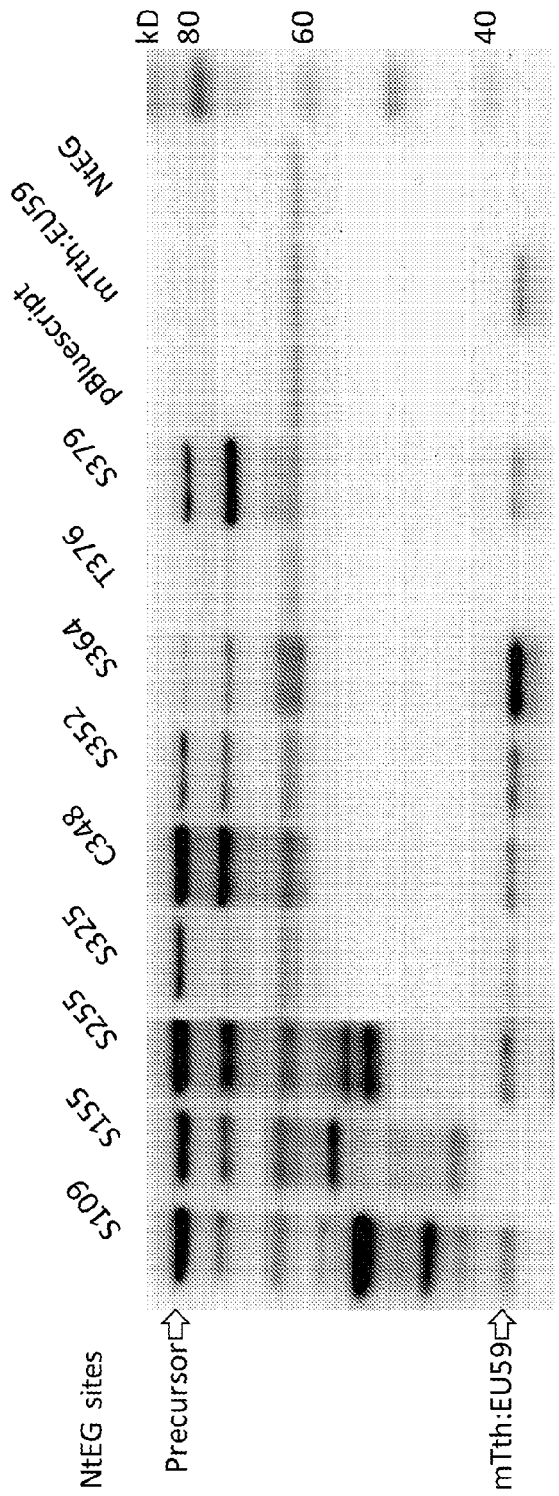
FIGS. 6A-6B illustrate that intein splicing leads to EU59 Xylanase activation. Intein splicing was analyzed by Western blot using an EU59-specific antibody.
Figure 6B:
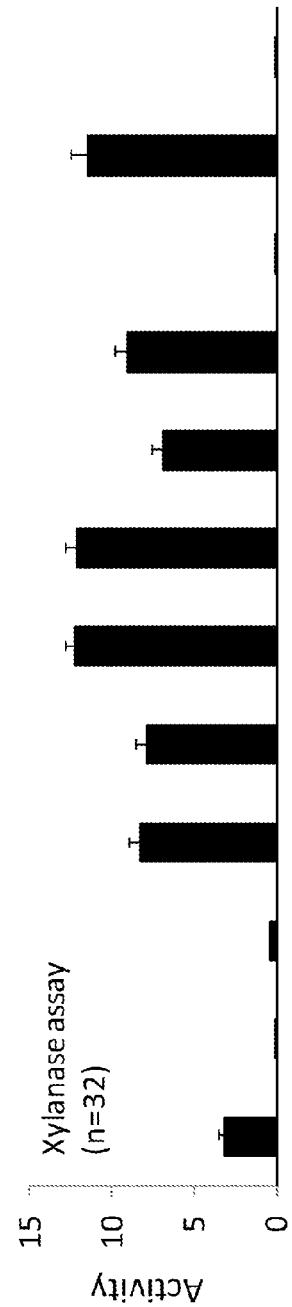

The nucleic acid encoding the modified mTth:EU59 intein [SEQ ID NO: 71] was inserted using PCR into 9 selected serine sites (S121, S138, S140, S146, S179, S187, S222, S249, and S251) of xylanase AAQ01666 [SEQ ID NO: 60], to create the following constructs (AAQS121:mTth:EU59 [SEQ ID NO: 89], AAQS138:mTth:EU59[SEQ ID NO: 90], AAQS140:mTth:EU59 [SEQ ID NO: 91], AAQS146:mTth:EU59 [SEQ ID NO: 92], AAQS179:mTth:EU59[SEQ ID NO: 93], AAQS187:mTth:EU59 [SEQ ID NO: 94], AAQS222:mTth:EU59 [SEQ ID NO: 95], AAQS249:mTth:EU59 [SEQ ID NO: 96], and AAQS251:mTth:EU59 [SEQ ID NO: 97], encoding the following intein modified enzymes (AAQS121:mTth:EU59 [SEQ ID NO: 32], AAQS138:mTth:EU59[SEQ ID NO: 33], AAQS140:mTth:EU59 [SEQ ID NO: 34], AAQS146:mTth:EU59 [SEQ ID NO: 35], AAQS179:mTth:EU59[SEQ ID NO: 36], AAQS187:mTth:EU59 [SEQ ID NO: 37], AAQS222:mTth:EU59 [SEQ ID NO: 38], AAQS249:mTth:EU59 [SEQ ID NO: 39], and AAQS251:mTth:EU59 [SEQ ID NO: 40], as shown in FIGS. 4A-4B.

The constructs were cloned into the lambda ZAPII vector and expressed in SOLR cells as described in Example 1.

Intein splicing restored xylanase activity. *E. coli* SOLR cells expressing the intein modified xylanase were grown and enzyme activity was assayed from bacterial lysates as described above. FIG. 4A shows results of the enzyme activity assay. The wild type xylanase AAQ01666 (AAQ01666 wt) [SEQ ID NO: 3] has no detectable hydrolytic activity on AZCL-xylan substrate. Yet the hydrolytic activity from mTth:EU59 intein is readily detectable on agar plates containing AZCL-xylan. Using mTth:EU59 hydrolytic activity as a reporter marker helps identify intein-modified AAQ01666 that splices. This EU59-derived xylanase activity was quantified by measuring the absorbance of reactions in which total cell lysate expressing intein-modified AAQ01666 were incubated at different temperatures and plated onto AZCL-xylan substrate. For each construct AAQS121:mTth:EU59 [SEQ ID NO: 89], AAQS138:mTth:EU59 [SEQ ID NO: 90], AAQS140:mTth: EU59 [SEQ ID NO: 91], AAQS146:mTth:EU59 [SEQ ID NO: 92], AAQS179:mTth:EU59 [SEQ ID NO: 93], AAQS187:mTth:EU59 [SEQ ID NO: 94], AAQS222:mTth: EU59 [SEQ ID NO: 95], AAQS249:mTth:EU59 [SEQ ID NO: 96], AAQS251:mTth:EU59 [SEQ ID NO: 97], total cell lysate of eight biological replicas were incubated at 37° C. (opened rectangle) and 60° C. (closed rectangle) for four hours, respectively, to facilitate splicing. The proteins from the same set of samples were also resolved on SDS-PAGE gel and Western blotted using antibodies specific to xylanase EU59 (FIG. 4B). Referring to FIGS. 4A and 4B, while most mTth:EU59 intein-modified AAQ01666 demonstrated spontaneous intein splicing and xylanase activity at 37° C. and 60° C., one such intein modified xylanase AAQS146:mTth: EU59 [SEQ ID NO: 35] (mTth:EU59 in S146 site) produced more xylanase activity and apparently more spliced mTth: EU59 intein at 60° C. than at 37° C. Thus, heat induced xylanase activity correlated with heat induced intein splicing.

Example 6. Splicing of Intein-Modified NtEG Cellulase

Expression and splicing of intein-modified NtEG can be evaluated either by phage on agar plates with AZCL-xylan substrate or E. coli lysate with substrate either for EU59 xylanase (AZCL-xylan) or NtEG cellulase (barley-beta-glucan).

As shown in FIGS. 5A-5B and 6A-6B, respective cellulase and xylanase activity was restored after intein splicing from NtEG:mTth:EU59. It was observed that hydrolytic activity derived from mTth:EU59 intein correlated with activity derived from NtEG, suggesting that a xylanase and a cellulase could be co-expressed as a fused peptide (shown as precursor in FIG. 5A and FIG. 6A) that could later produce two enzymes upon post translational splicing (shown as NtEG and mTth:EU59 in FIG. 5B and FIG. 6B).

Intein splicing is mediated by amino acids located in both the C-terminal extein and intein. Critical intein elements include first (usually a cysteine) and last (usually an asparagine) amino acids of the intein. Mutation of these two amino acids most often eliminates the intein's ability to splice (crippled intein). In mTth:EU59 intein, these two amino acids were identified to be C1 and N333. Double mutations (C1A, cysteine to alanine mutation and N333A, asparagine to alanine mutation) were generated in the mTth:EU59 intein by site-directed mutagenic PCR to create the crippled intein (mTth-c:EU59). Mutant constructs (NtEGS352:mTth-c:EU59 [SEQ ID NO:98] and NtEGS364:mTth-c:EU59 [SEQ ID NO: 99]) were cloned into lambda ZAP, expressed in E. coli SOLR cells and assayed for activity and intein splicing as described above after pretreatment at 37° C. and 55° C. for 2 hrs.

Figure 7A:
FIG. 7A illustrates that intein splicing from the multiprotein unit NtEG:mTth:EU59 is required to restore activity of the NtEG cellulase.
Figure 7B:
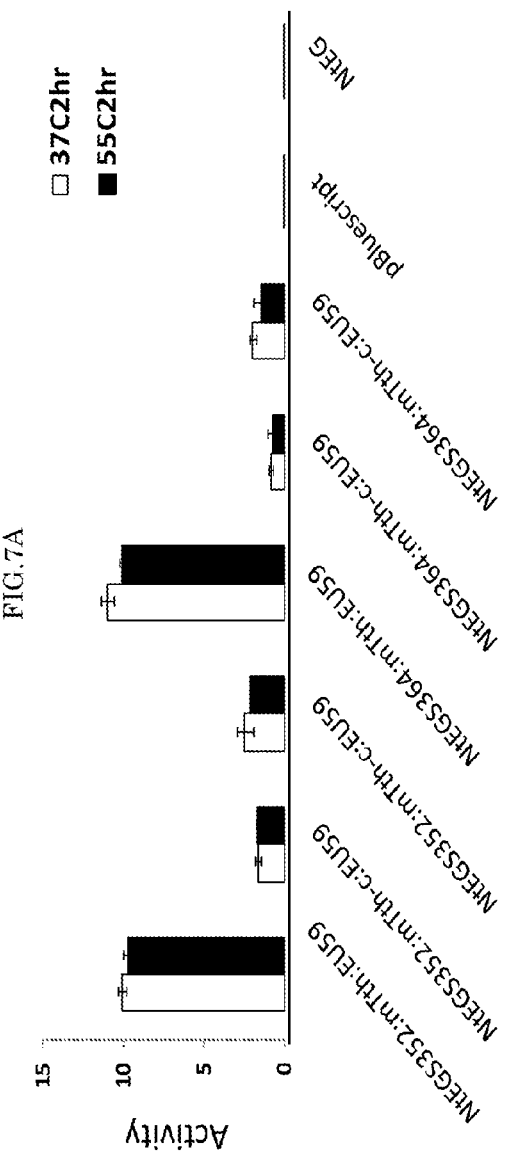
FIG. 7B illustrates that intein splicing from the multiprotein unit NtEG:mTth:EU59 is required to restore activity of the EU591793 xylanase.

Referring to FIGS. 7A and 7B, mutants with crippled inteins had very low hydrolytic activity on either barley-beta-glucan (FIG. 7A) or AZCL-xylan (FIG. 7B) substrates. In the activity assay, however, NtEGS352:mTth:EU59 [SEQ ID NO: 24] and NtEGS364:mTth:EU59 [SEQ ID NO: 25] were able to recover high level of both NtEG (FIG. 7A) and EU59 activity (FIG. 7B).

Figure 8:
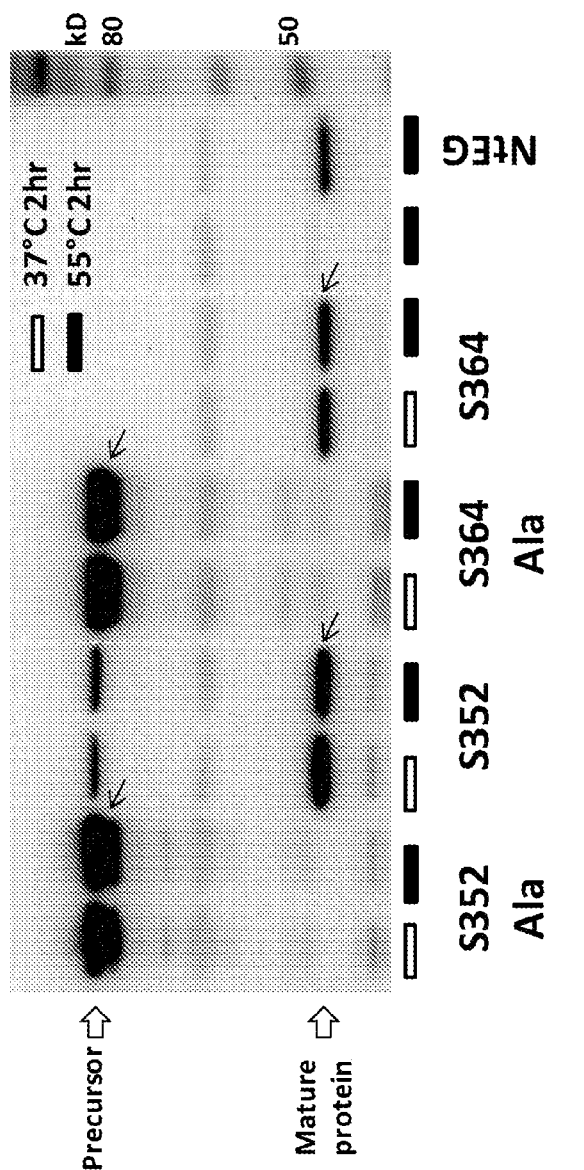
FIG. 8 illustrates the splicing deficiency of the crippled mTth:EU59 intein analyzed by Western blot using the NtEG-specific antibody.

Western blot analysis was conducted to demonstrate that the ability in the modified mTth:EU59 intein or inability in the crippled mTth-c:EU59 intein to recover EU59 and NtEG activity is due to splice or unsplice, as described in Example 1, using antibody against NtEG and EU59 (FIG. 8). Indeed, C1A and N333A mutations in the mTth:EU59 intein eliminated its ability to splice at both S352 and S364 sites.

Referring to FIGS. 7A-7B and 8, it was observed that loss of activity in crippled mutants (FIGS. 7A-7B) was due to impairment of intein splicing (FIG. 8), providing further support that mTth:EU59 functions as an intein and suggesting that enzymes in the multiprotein expression unit could be simultaneously regulated by one intein.

Example 7. Construction and Use of Modified Inteins Pho_RadA:EU59 and Tko_RadA:EU59

Figure 9:
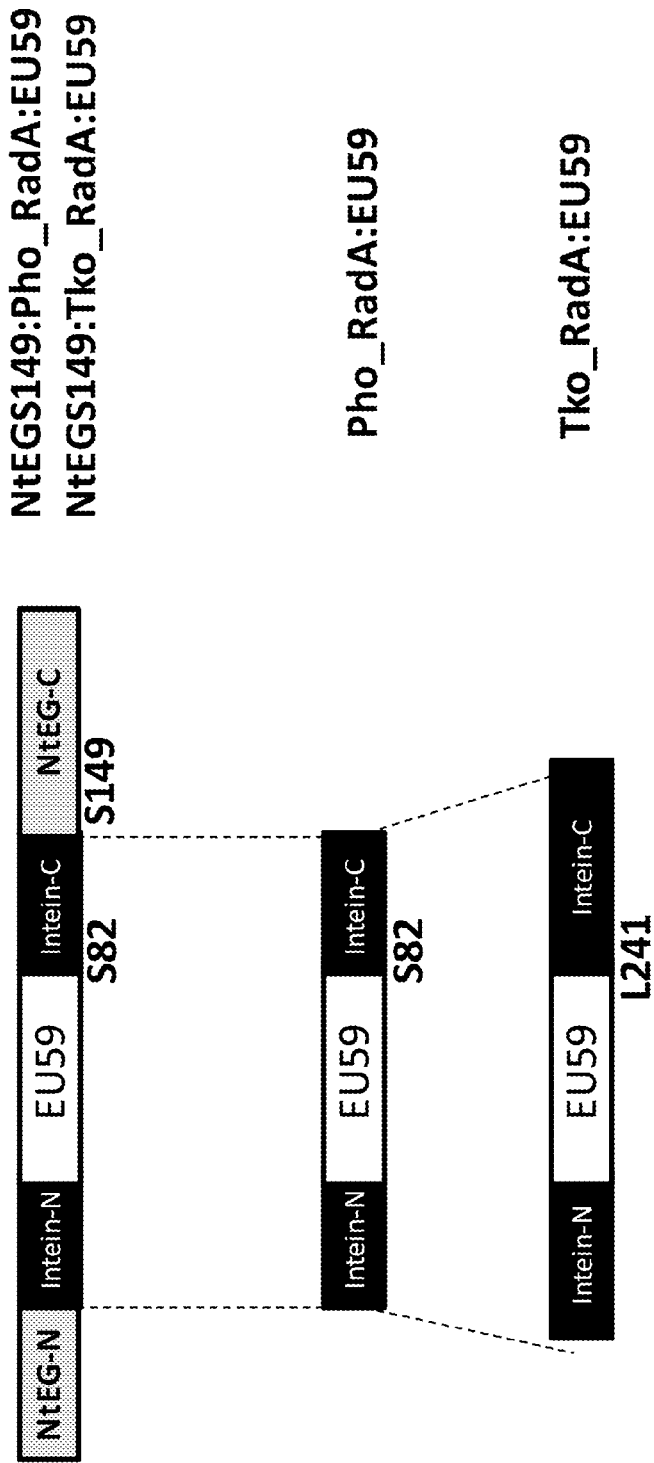
FIG. 9 illustrates the construction of an intein-modified NtEG gene.

The sequence of EU591743 xylanase [SEQ ID NO: 6] was also inserted into inteins Pho_RadA [SEQ ID NO: 10] and Tko_RadA [SEQ ID NO: 11] (FIG. 9). While Pho_RadA does not have a homing endonuclease domain (HEN), Tko_RadA does. Instead of replacing the HEN domain, EU59 was inserted inside the HEN domain of the native Tko_RadA intein prior the L241 codon. To construct the modified Pho_RadA intein, EU59 xylanase was inserted, using PCR, before the S82 codon of Pho_RadA. The constructs were cloned in ZAP vector and expressed in E. coli SOLR cells as described in Example 1. Referring to FIG. 9, the nucleic acids sequences encoding two modified inteins, Pho_RadA:EU59 and Tko_RadA:EU59, were inserted into NtEG at four insertion sites (before S149, T179, T200 and S352 codon) to create NtEGS149:Pho_RadA:EU59 [SEQ ID NO: 100], NtEGT179:Pho_RadA:EU59 [SEQ ID NO: 101], NtEGT200:Pho_RadA:EU59 [SEQ ID NO: 102], NtEGS352:Pho_RadA:EU59 [SEQ ID NO: 103], NtEGS149:Tko_RadA:EU59 [SEQ ID NO: 104], NtEGT179:Tko_RadA:EU59 [SEQ ID NO: 105], NtEGT200:Tko_RadA:EU59 [SEQ ID NO: 106], NtEGS352:Tko_RadA:EU59 [SEQ ID NO: 107] encoding intein modified NtEG proteins NtEGS149:Pho_RadA:EU59 [SEQ ID NO: 43], NtEGT179:Pho_RadA:EU59 [SEQ ID NO: 44], NtEGT200:Pho_RadA:EU59 [SEQ ID NO: 45], NtEGS352:Pho_RadA:EU59 [SEQ ID NO: 46], NtEGS149: Tko_RadA:EU59 [SEQ ID NO: 47], NtEGT179:Tko_RadA:EU59 [SEQ ID NO: 48], NtEGT200:Tko_RadA: EU59 [SEQ ID NO: 49], NtEGS352:Tko_RadA:EU59 [SEQ ID NO: 50] and tested for the enzyme activity and intein splice. Xylanase activity (derived from mTth:EU59 intein) could be detected on agar plates and cellulase activity (derived from intein-modified NtEG) could be measured in cell lysate. Yet, the recovered cellulose activity was less than 20% of the wild type NtEG activity with Pho_RadA and Tko_RadA inteins.

Figure 10:
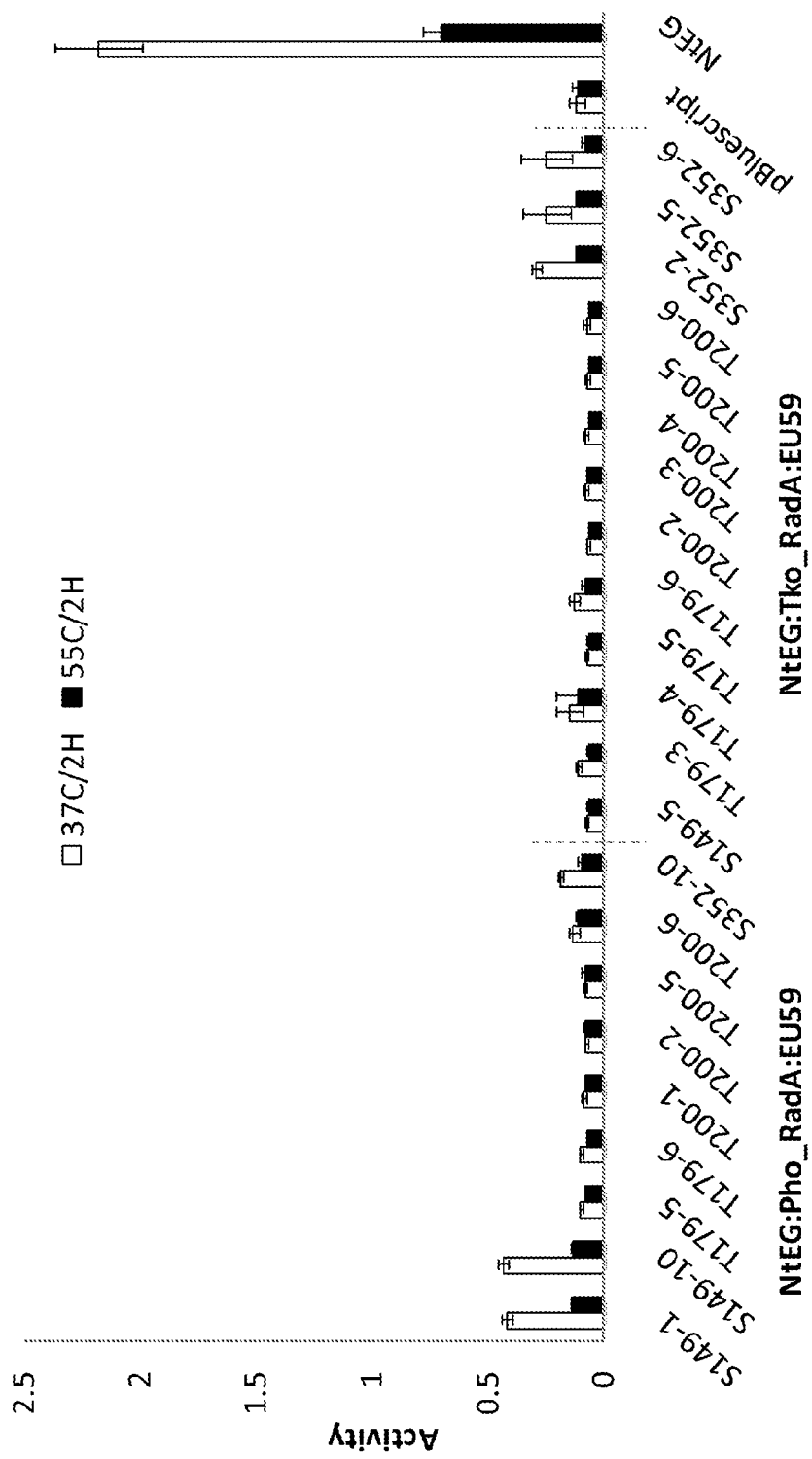
FIG. 10 illustrates NtEG activity assay.

Pho_RadA:EU59 intein-modified NtEG and Tko_RadA: EU59 intein-modified NtEG (at 4 insertion sites: S149, T179, T200 and S352) were expressed in E. coli SOLR cells (8 biological replicates) in AIM as described in Example 1. Total cell lysate was preheated at 37° C. or 55° C. for 2 hrs, and incubated with barley beta-glucan substrate at 37° C. for 18 hrs. Absorbance at 590 nm was measured (FIG. 10).

Figure 11:
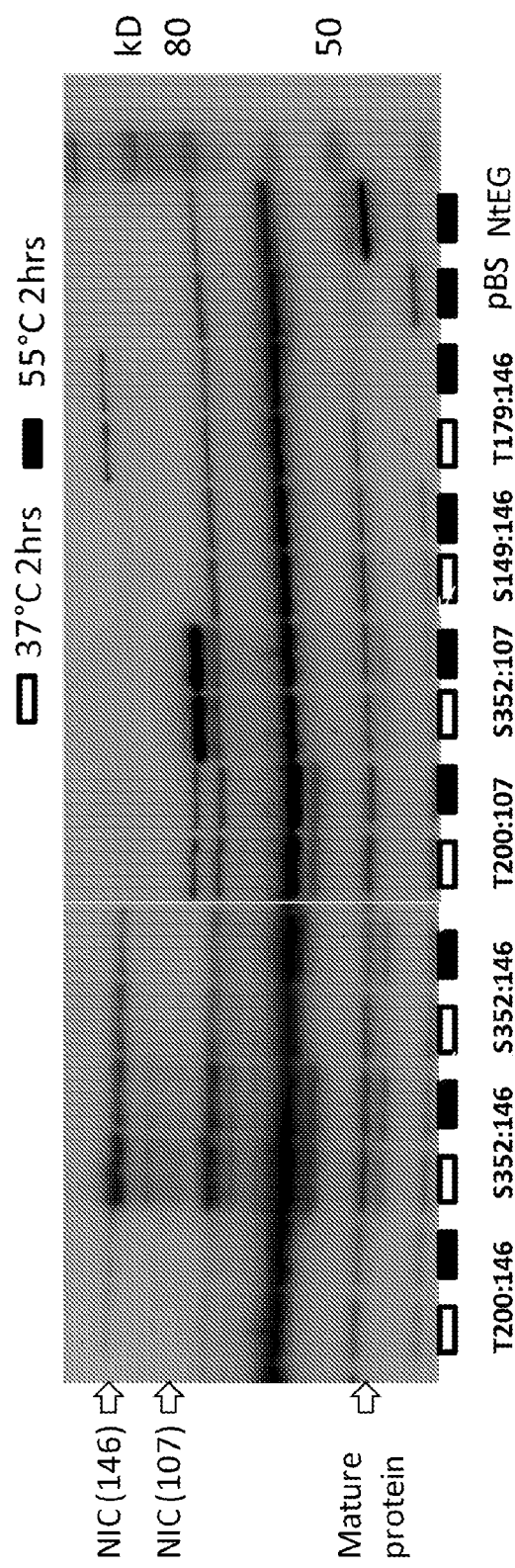
FIG. 11 illustrates heat-induced splicing of the intein-modified NtEG analyzed by Western blot using an NtEG-specific antibody.

Western blot analysis of selected intein-modified NtEG showed that the recovered activity correlated with intein splicing (FIG. 11).

FIG. 11 illustrates Western blot showing splicing of the modified inteins Pho_RadA:EU59 (referred to as 107) and Tko_RadA:EU59 (referred to as 146). Referring to this figure, inteins were inserted into NtEG before the S149, T179, T200 and S352 codons and several individual clones were tested for each intein-modified NtEG. Total cell lysate was preheated at 37° C. and 55° C. for 2 hrs. NtEG-specific antibody was used. Arrows highlight mature protein, demonstrating that both modified inteins spliced.

Figure 12:
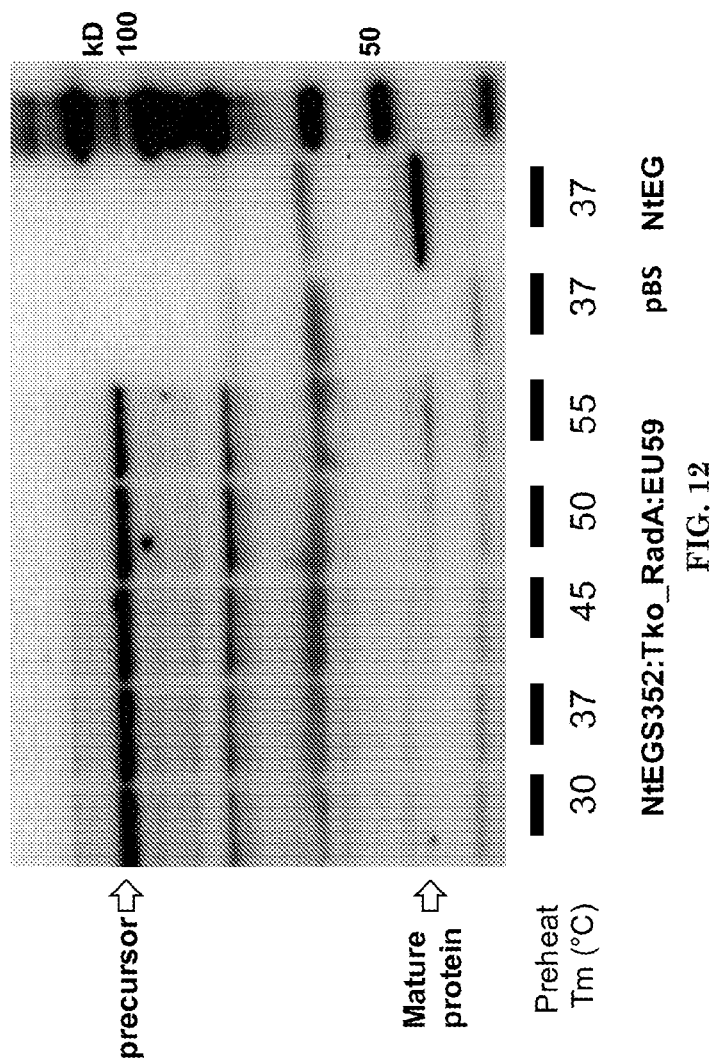
FIG. 12 illustrates heat-induced splicing of the intein-modified NtEGS352:TKO_RadA:EU59 protein analyzed by Western blot using NtEG-specific antibody.

FIG. 12 illustrates that Tko_RadA:EU59 intein could be engineered by mutagenesis to splice in response to elevated temperatures. First, Tko_RadA:EU59 intein was mutagenized and inserted into NtEG at S352 site, both by PCR. The resulting molecules were expressed from the Lambda ZAP vector and screened on agar plates with AZCL-xylan substrate for heat induced xylalanse activity, indicative of Tko_RadA:EU59 intein splicing. Referring to FIG. 12, cell lysate from a NtEGS352:Tko_RadA:EU59 mutant variant was heated for 2 hrs at the following temperatures, 30° C., 37° C., 45° C., 50° C. and 55° C., to induce intein splicing. NtEG specific antibody was used. The highlighted band that matches the wild type NtEG demonstrates heat induced splicing.

Example 8. Optimizing Savinase Expression

Cytoplasmic Expression of Savinase in *E. coli*

Figures 13A, 13B:
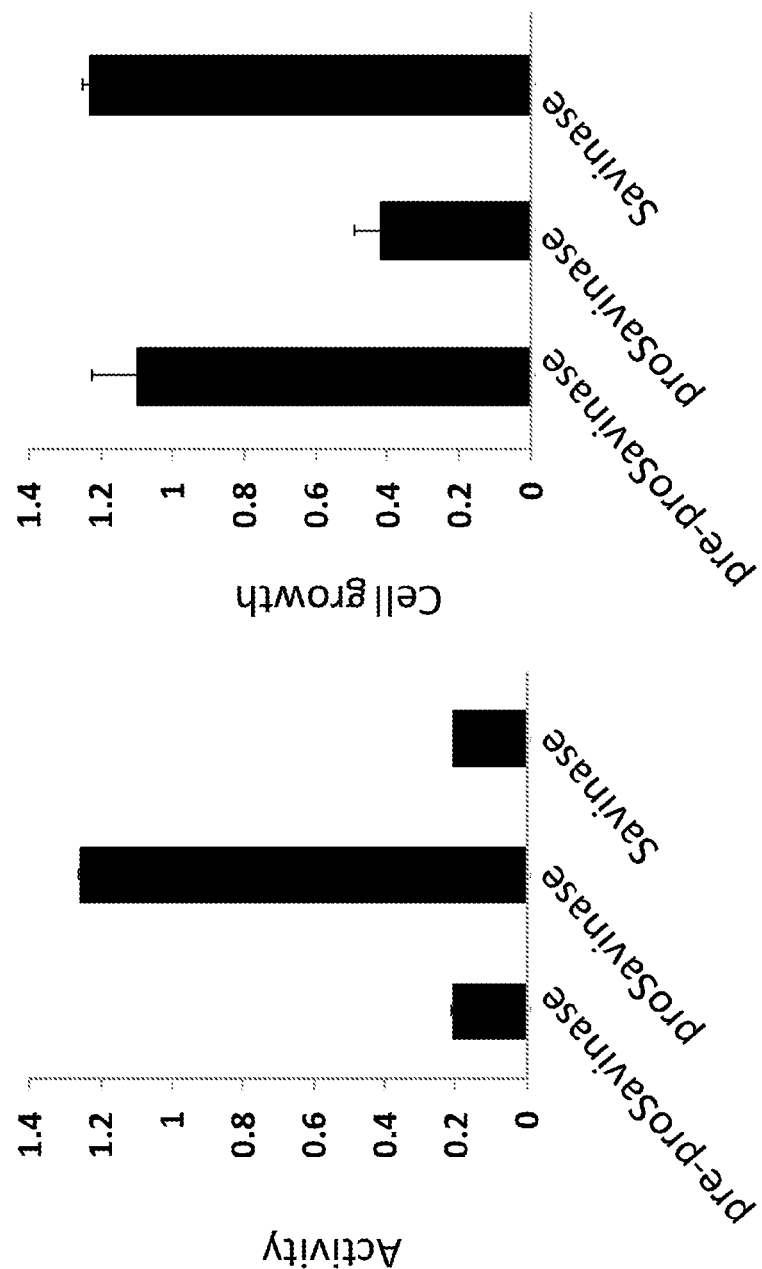
FIG. 13A illustrates Savinase activity in *E. coli* SOLR cells.
FIG. 13B illustrates an impact of savinase activity on the growth of *E. coli* SOLR cells.

To test cytoplasmic expression of Savinase in *E. coli*, nucleotide sequences of the full length protein preproSavinase, the proSavinase and the Savinase catalytic domain were cloned into the EcoRI/XhoI sites of pBluescript II XR (Agilent) and expressed in *E. coli* SOLR (Stratagene). Savinase activity was assayed from overnight cultures grown in 5 mL Overnight Express Instant TB Medium (AIM, Novagen) supplemented with carbenicillin 100 mg/L, at 37° C./300 rpm. Cells were harvested at 3000 rpm/10 min/4° C. and the pellet was lysed in 100 µL Fast break (1×) poly-buffer (pH 6.5) for 60 min, then additional 400 µL poly-buffer was added. To assay enzyme activity 100 µL lysate was added to 100 µL of 1% AZO-casein in 0.1 M Tris.HCl pH 8.0 containing 0.5 mM CaCl2 and samples were incubated at 55° C. for 30 min. Reaction was stopped by adding 200 µL of 5% (w/v) trichloracetic acid, pelleted at 5000 rpm for 5 min, and the absorbance was measured in the supernatant at 340 nm. FIG. 13A illustrates enzyme activity in cell lysates. It was observed that activity was detectable only from the proSavinase expression cassette, while expression of the full length protein or the catalytic domain alone gave no Savinase activity.

An impact of Savinase activity on the growth of *E. coli* SOLR cells was assessed (FIG. 13B). *E. coli* SOLR expressing the full length protein preproSavinase, the proSavinase and the Savinase catalytic domain were inoculated into 5 mL Overnight Express Instant TB Medium (AIM, Novagen) supplemented with carbenicillin (100 mg/L) and were grown at 37° C. 10 hrs followed by 30° C. 6 hrs. Absorbance of 500 µL culture was measured at 590 nm. Referring to FIG. 13B, it was observed that *E. coli* SOLR cells expressing active pro-Savinase grew poorly, while cells expressing prepro-Savinase and Savinase catalytic domain grew normally. The cytoplasmic expression of the proSavinase therefore reduced cell growth, indicating that the protease activity is detrimental to the cells as can be observed in FIG. 13B.

Example 9. Intein Insertions into proSavinase

The mTth:EU59 recombinant intein was inserted into 20 sites before the underlined amino acids: S46, S62, T77, S86, S100, T109, S135, T148, S166, T167, S196, S208, S239, T243, S269, T285, S293, S317, T318, T329 of the proSavinase (SEQ ID NO: 149):

```
MAEEAKEKYLIGFNEQEAVSEFVEQVEANDEVAILSEEEEVE

IELLHEFETIPVLSVELSPEDVDALELDPAISYIEEDAEVTT

MAQSVPWGISRVQAPAAHNRGLTGSGVKVAVLDTGISTHPDL

NIRGGASFVPGEPSTQDGNGHGTHVAGTIAALNNSIGVLGVA

PSAELYAVKVLGASGSGSVSSIAQGLEWAGNNGMHVANLSLG
```

-continued
```
SPSPSATLEQAVNSATSRGVLVVAASGNSGAGSISYPARYAN

AMAVGATDQNNNRASFSQYGAGLDIVAPGVNVQSTYPGSTYA

SLNGTSMATPHVAGAAALVKQKNPSWSNVQIRNHLKNTATSL

GSTNLYGSGLVNAEAATR.
```

The constructs were cloned between the EcoRI and XhoI sites of the pBluescript II XR (Agilent) and transformed them into *E. coli* SOLR (Stratagene). Nucleotide sequences of the modified mTth:EU59 intein (SEQ ID NO: 71) were inserted into proSavinase using overlapping PCR and resulted in genetic constructs iproSavinaseS46:mTth:EU59 (SEQ ID NO: 150), iproSavinaseS62:mTh:EU59 (SEQ ID NO: 151), iproSavinaseT77:mTth:EU59 (SEQ ID NO: 152), iproSavinaseS86:mTth:EU59 (SEQ ID NO: 153), iproSavinaseS100:mTth:EU59 (SEQ ID NO: 154), iproSavinaseT109:mTth:EU59 (SEQ ID NO: 155), iproSavinaseS135:mTth:EU59 (SEQ ID NO: 156), iproSavinaseT148:mTth:EU59 (SEQ ID NO: 157), iproSavinaseS166:mTth:EU59 (SEQ ID NO:158), iproSavinaseT167:mTth:EU59 (SEQ ID NO: 159), iproSavinaseS196:mTth:EU59 (SEQ ID NO: 160), iproSavinaseS208:mTth:EU59 (SEQ ID NO: 161), iproSavinaseS239:mTth:EU59 (SEQ ID NO: 162), iproSavinaseT243:mTth:EU59 (SEQ ID NO: 163), iproSavinaseS269:mTth:EU59 (SEQ ID NO:164), iproSavinaseT285:mTth:EU59 (SEQ ID NO: 165), iproSavinaseS293:mTth:EU59 (SEQ ID NO:166), iproSavinaseS317:mTth:EU59 (SEQ ID NO:167), iproSavinaseT318: mTth:EU59 (SEQ ID NO: 168), and iproSavinaseT329:mTth:EU59 (SEQ ID NO:169) encoding intein-modified proSavinase iproSavinaseS46:mTth:EU59 (SEQ ID NO: 171), iproSavinaseS62:mTh:EU59 (SEQ ID NO: 172), iproSavinaseT77:mTth:EU59 (SEQ ID NO: 173), iproSavinaseS86:mTth:EU59 (SEQ ID NO: 174), iproSavinaseS100:mTth:EU59 (SEQ ID NO: 175), iproSavinaseT109:mTth:EU59 (SEQ ID NO: 176), iproSavinaseS135:mTth:EU59 (SEQ ID NO: 177), iproSavinaseT148:mTth:EU59 (SEQ ID NO: 178), iproSavinaseS166:mTth:EU59 (SEQ ID NO:179), iproSavinaseT167:mTth:EU59 (SEQ ID NO: 180), iproSavinaseS196:mTth:EU59 (SEQ ID NO: 181), iproSavinaseS208:mTth:EU59 (SEQ ID NO: 182), iproSavinaseS239:mTth:EU59 (SEQ ID NO: 183), iproSavinaseT243:mTth:EU59 (SEQ ID NO: 184), iproSavinaseS269:mTth:EU59 (SEQ ID NO: 185), iproSavinaseT285:mTth:EU59 (SEQ ID NO: 186), iproSavinaseS293:mTth:EU59 (SEQ ID NO:187), iproSavinaseS317:mTth:EU59 (SEQ ID NO: 188), iproSavinaseT318: mTth:EU59 (SEQ ID NO: 189), and iproSavinaseT329:mTth:EU59 (SEQ ID NO:190).

Example 10. Intein Insertion into proSavinase can Suppress and Splicing can Restore Savinase Activity

*E. coli* SOLR cells expressing the intein-modified pro-Savinase were grown at 37 C overnight in LB with Amp (50 mg/L) and enzyme activity was assayed from bacterial lysates as described in Example 1. FIG. 14A shows results of the activity assay from representative constructs. For each construct, 8 biological replicates were tested, with one aliqout being pre-incubated at 37° C. (filled rectangle) and another at 55° C. (open rectangle) for 2 hrs, to facilitate splicing and recovery of enzyme activity before the enzyme activity was assayed. In this assay, Savinase activity was observed in several intein-modified proSavinases (S135, S269, S293 and S317), with the exception of the T318 insertion which recovered only trace amounts of activity.

E. coli SOLR cells expressing the intein-modified proSavinases were grown in overnight cultures and cell lysates were prepared as in the method described in Example 1. To test for temperature shift inducible splicing, aliquots of cell lysate were incubated separately at 4° C., 37° C. or 55° C. for 2 hrs, then proteins were resolved on SDS/PAGE and Western blotted using the intein specific antibody against EU59. FIG. 14B shows Western blots of intein splicing of representative insertions. Positions of the intein-modified proSavinase (NIC) and the free intein (mTth:EU59) released after splicing are marked at the left. Intein insertion sites are indicated below. The three lanes above each insertion site are aliquots pretreated at 4, 37 and 55° C. for 2 hrs, respectively. Listed below the Western blot, (+) or (−) denotes presence or absence of the spliced free intein and Savinase activity for each insertion site. Intein splicing, scored by release of the modified intein from the precursor, was detectable at five out of the 20 insertion sites tested including S135, S269, S293, S317, and T318. Referring to FIG. 14A, high level of protease activity was detected in the same constructs (S135, S269, S293, S317) that showed intein splicing (FIG. 14B). In contrast, no activity was detectable in the nonsplicing constructs (T167 and T285) that accumulated only intein-modified precursors yet no mTth:EU69 intein. These results demonstrated that intein splicing restored Savinase activity and suggested that intein modification could be a useful tool to control protease activity.

Once the intein-modified protease genes were assembled, they could be screened for inducible activity. In one example, screen of cold induced protease was based on toxicity of protease to the growth of bacterial host. Out of the 20 mTth:EU59 intein-modified variants of proSavinase, two (S135 and S317) showed spontaneous splicing when cell lysate was pretreated at 4° C., 37° C. and 55° C., and followed by protease activity assay and Western blot. Inteinmodified proSavinase that splices spontaneously was PCR mutagenized to generate conditionally (temperature, pH and diluted detergent) splicing variants that did not splice at 37 C, allowing expression of the inactive Savinase precursor. The mutagenized library was expressed in E. coli SOLR cells and grown in LB liquid medium with carbenicillin (100 µg/mL) and IPTG (1.0 mM) at 37° C. overnight. Under this cultural condition, variants showing conditional intein splicing accumulated intein-modified protease precursor and underwent normal cell division, wherein variants with spontaneously spliced protease were reduced or eliminated in the population due to toxicity of active protease to the host cells. The mutagenized library with enriched conditional (inducible) splicing variants was then plated out on LB agar plates containing IPTG (1.0 mM) and carbenicillin (100 µg/mL) to form individual colonies. In one instance, colonies from the conditional-variant enriched library were individually grown overnight in 96-well plates with AIM medium containing carbenicillin (100 µg/mL) at 37° C. Cell lysates were prepared using Fastbreak lysis buffer and aliquoted into replicate sets of 384-well plates. One set of replicate cell lysate plates was kept at 37° C. for 2 hrs to serve as a control and the second set was kept at 20° C. for 2 hrs (for cold induction). Differently treated cell lysates were assayed for protease activity by using the method described in Example 1. Difference in protease activity between treatments suggested cold induced intein splicing. Similar procedure was used to select variants inducible by pH change and detergent.

Example 11. Construction of mVMA:P77Cd and mTth:P77Cd Inteins

Like EU59, XynB (Accession number P77853) is also a GH11 family xylanase. Its catalytic domain (P77Cd) [SEQ ID NO: 5] has sequence homology to EU59 xylanase [SEQ ID NO: 6]. Compared to the full length XynB, P77Cd expressed well in E. coli, was highly soluble in solutions and showed increased thermo-tolerance and specific activity. SceVMA is an intein that has been extensively studied and successfully used in developing cold inducible protein switch. A homing endonuclease domain was predicted in its sequence.

Figure 15A:
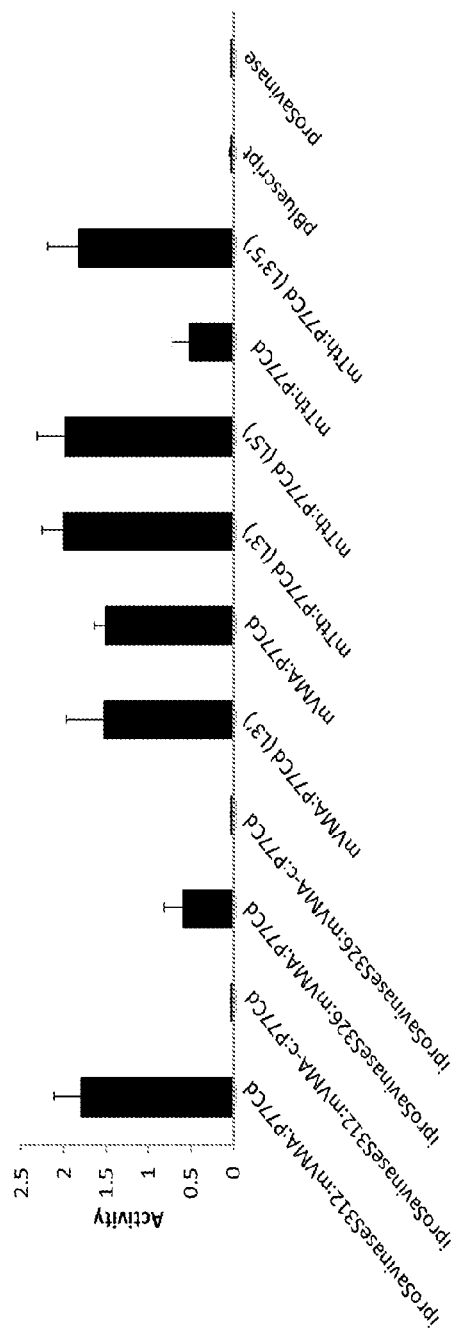
FIGS. 15A-15B illustrate that splicing of mVMA:P77Cd and mTth:P77Cd inteins restores proSavinase activity

P77Cd was fused internally into SceVMA in place of the HEN domain. Four constructs were generated, either without a link or with the eight amino acid link at the N-terminal, or the C-terminal or both N- and C-termini of P77Cd. When expressed in E. coli, the constructs with none or one link between P77Cd and SceVMA gave better xylanase activity on AZCL-xylan substrate, demonstrating xylanase activity in the modified mVMA:P77Cd intein (FIG. 15A). The nucleotide sequence encoding the modified mVMA:P77Cd intein [SEQ ID NO: 75] was then inserted into proSavinase [SEQ ID NO: 207] before S135, S265, S269, S293, S312, S317 and S326 codons to generate constructs iproSavS135:mVMA:P77Cd [SEQ ID NO: 108], iproSavS265:mVMA:P77Cd [SEQ ID NO: 109], iproSavS269:mVMA:P77Cd [SEQ ID NO: 110], iproSavS293:mVMA:P77Cd [SEQ ID NO: 111], iproSavS312:mVMA:P77Cd [SEQ ID NO: 112] iproSavS317:mVMA:P77Cd [SEQ ID NO: 113], and iproSavS326:mVMA:P77Cd [SEQ ID NO: 114]. iproSavS312:mVMA-c:P77Cd [SEQ ID NO: 237] and iproSavS326:mVMA-c:P77Cd [SEQ ID NO: 238] were also generated in which both the first and last amino acids of the mVMA:P77Cd intein were replaced with an alanine. Enzymatic assay was used to test if the modified intein can splice, as described in Example 1.

P77Cd was inserted in mTth at the same site where EU59 was inserted (see Example 2). Four mTth:P77Cd constructs were generated by PCR, and expressed in E. coli SOLR cells as described in Example 1. Xylanase activity assay showed that three (with a linker at 3' or 5' or both ends of P77Cd) of the four constructs yielded similar but higher xylanase activity than the one without a linker between P77Cd and mTth (FIG. 15A). The construct that has a 3' linker was inserted in proSavinase at S135, S269, S293 and S5317 sites to generate the following new constructs iproSavS135:mTth:P77Cd [SEQ ID NO: 226], iproSavS269:mTth:P77Cd [SEQ ID NO: 227], iproSavS293:mTth:P77Cd [SEQ ID NO: 228], and iproSavS317:mTth:P77Cd [SEQ ID NO: 229]. Enzymatic assay was used to test if the modified intein can splice, as described in Example 1.

Figure 15B:
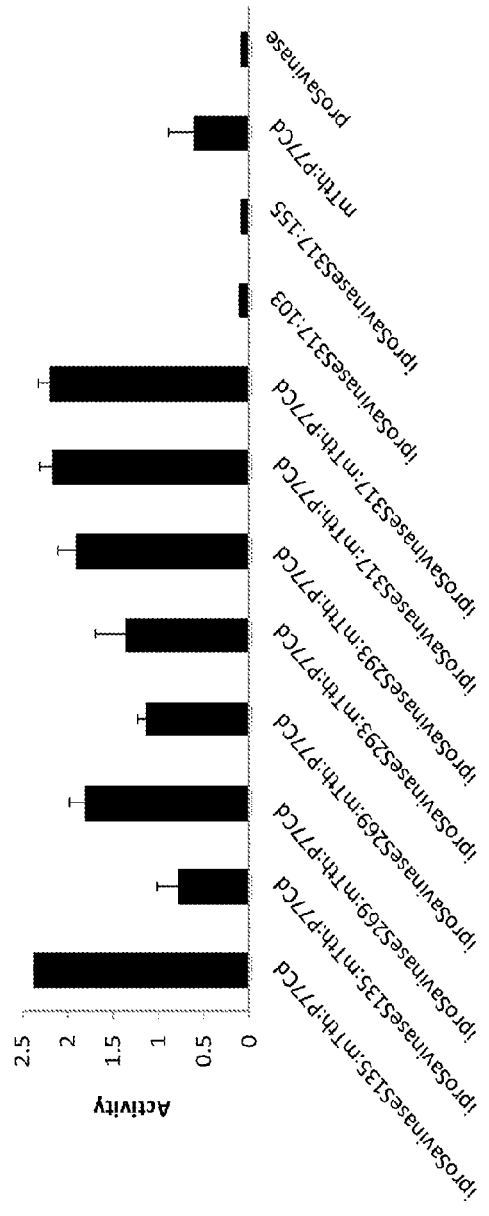

Referring to FIG. 15A, Savinase activity was detected in iproSavS312:mVMA:P77Cd and iproSavS326:mVMA:P77Cd, To see if the recovered enzymatic activity was due to intein splicing, alanine mutations were introduced at the termini of the intein. Referring to FIG. 15A, alanine mutants (iproSavS312:mVMA-c:P77Cd and iproSavS326:mVMA-c:P77Cd) indeed lost activity in the same enzymatic assay, suggesting that mVMA:P77Cd intein can splice. Similarly, the mTth:P77Cd-modified proSavinase constructs were expressed and assayed for xylanase activity. Notably, all constructs tested showed xylanase activity (FIG. 15B), suggesting that mTth:P77Cd intein could splice.

Example 12. Stacking Lipase and Savinase by Using mTth:O59 and Hwa:O59 Inteins

Lipase is an enzyme that catalyzes the breakdown or hydrolysis of fats (lipids). Lipases serve important roles in human practices such as yogurt and cheese fermentation, baking, laundry detergents and even as biocatalysts to convert vegetable oil into fuel and in processing biodiesel.

In industrial application such as laundry detergent, lipase is formulated into an enzyme cocktail that contains various enzymes including protease. Lipase becomes a target of protease during storage which cuts lipase shelf life. One strategy to shield lipase from protease degradation is to conditionally regulate protease activity by intein splicing. Intein can be engineered to carry first enzyme, such as lipase, that regains activity after intein splices from a second target protein, such as protease.

First, lipase (accession number O59953) was inserted into two inteins, mTth and Hwa_MCM1, by overlapping PCR with the following modified lipase intein constructs: mTth:O59_1 [SEQ ID NO: 191], mTth:O59_2 [SEQ ID NO: 192], mTth:O59_3 [SEQ ID NO: 193], mTth:O59_4 [SEQ ID NO: 194], mTth:O59_5 [SEQ ID NO: 195], mTth:O59_6 [SEQ ID NO: 196], Hwa:O59_1 [SEQ ID NO: 197], Hwa:O59_2 [SEQ ID NO: 198], Hwa:O59_3 [SEQ ID NO: 199], Hwa:O59_4 [SEQ ID NO: 200], Hwa:O59_5 [SEQ ID NO: 201] Hwa:O59_6 [SEQ ID NO: 202], Hwa:O59_7 [SEQ ID NO: 203], Hwa:O59_8 [SEQ ID NO: 204], and Hwa:O59_9 [SEQ ID NO: 205] encoding modified lipase intein proteins mTth:O59_1 [SEQ ID NO: 209], mTth:O59_2 [SEQ ID NO: 210], mTth:O59_3 [SEQ ID NO: 211], mTth:O59_4 [SEQ ID NO: 212], mTth:O59_5 [SEQ ID NO: 213], mTth:O59_6 [SEQ ID NO: 214], Hwa:O59_1 [SEQ ID NO: 215], Hwa:O59_2 [SEQ ID NO: 216], Hwa:O59_3 [SEQ ID NO: 217], Hwa:O59_4 [SEQ ID NO: 218], Hwa:O59_5 [SEQ ID NO: 219] Hwa:O59_6 [SEQ ID NO: 220], Hwa:O59_7 [SEQ ID NO: 221], Hwa:O59_8 [SEQ ID NO: 222], and Hwa:O59_9 [SEQ ID NO: 223].

Sites of insertion were based on previous testing for mTth and on computer modeling for Hwa_MCM1. Variations included length and composition of linkers at the lipase-intein junctions. Both insertion site and linker configuration had an impact on whether a modified intein could splice and how much activity the embedded enzyme could regain after splicing.

Modified lipase inteins that regained at least 50% wild type lipase activity were inserted into Savinase at S135 and S317 sites using yeast homologous recombination. Transformants from proSavi-Y vector were plated out on Ura⁻ glucose⁺ agar plates, from which 8 colonies were each inoculated in 100 μL Ura⁻ glucose⁺ liquid medium and grown at 30° C. overnight. Two microliter overnight cultures were inoculated into 100 μL Ura– galactose+ medium and grown at 30° C. overnight. Yeast cell growth was scored. Slow growth was observed in yeast cells transformed with mTth:O59 modified Savinase (ipro-SavS135:mTth:O59_1, ipro-SavS135:mTth:O59_2, ipro-SavS135:mTth:O59_3 and ipro-SavS135:mTth:O59_4), while cells transformed with Hwa:O59 intein modified Savinase grown normally.

Figure 16:
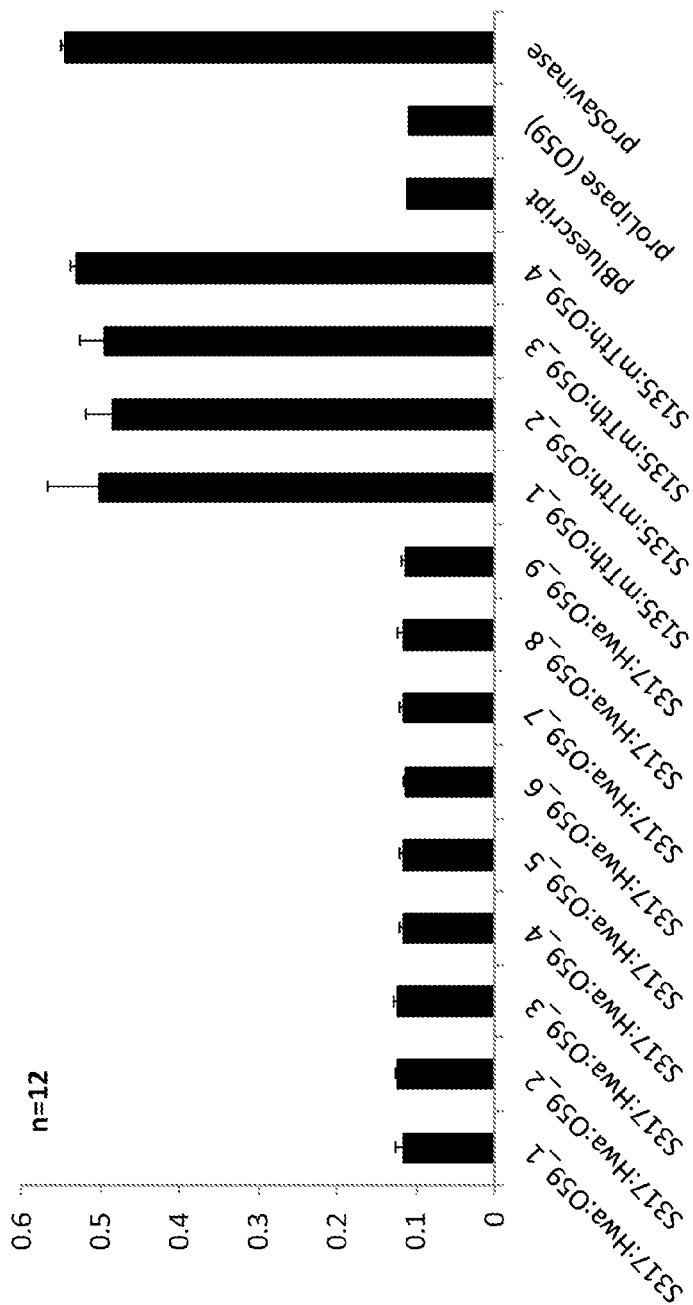
FIG. 16 illustrates protease activity in Hwa:O59-modified and mTth:O59-modified proSavinases

Transformants from proSavi-B vectors were similarly plated out on agar plates and single colonies inoculated in Leu⁻ glucose⁺ medium. DNA of the plasmid mini-prep was transformed into BL21 host cells. Twelve colonies were grown in 800 μL LB medium at 32° C. overnight. Cells were harvested and pellet resuspended in 100 μL fresh Fast break lysis buffer, and incubated at 37° C. for 1 hr. Cell lysate was processed and protease activity measured as described above. FIG. 16 shows that protease activity was detected in mTth:O59 modified Savinases: iproSavS317:mTth:O59_1, iproSavS317:mTth:O59_2, iproSavS317:mTth:O59_3, and iproSavS317:mTth:O59_4. Protease activity therefore matched cytotoxicity observed for the same constructs.

Example 13. Expression of Multiprotein Unit in Transgenic Plants

Maize (*Zea mays* cultivar Hi-II) plants were grown in a greenhouse (16 hrs of daylight with day time recorded temperatures ranging between 26° C.-38° C.). *Agrobacterium*-mediated transformation of immature maize embryos was performed as described previously (Negrotto D et al. 2000 Plant Cell Rep 19: 798; Ishida Y et al. 1996 Nat Biotech 14: 745). Immature zygotic embryos were removed from the kernels and inoculated with the *Agrobacterium* solution containing the constructs. After inoculation immature embryos were grown for 10-12 weeks. Seedlings with well-developed leaves and roots were PCR analyzed and transgenic plants containing the genes of interest were grown in the greenhouse to maturation.

Xylanase and cellulase activity from the green tissue of transgenic maize was assayed. Briefly, 20 mg leaf tissue was ground in homogenization buffer [sodium phosphate (100 mM, pH 6.5), ethylenediaminetetraacetic acid (EDTA; 1 mM), Triton X-100 (0.1%, v/v) and phenylmethanesulfonylfluoride (PMSF; 0.1 mM)]. Resuspended tissue samples were mixed thoroughly and homogenates transferred to a new tube. Xylanase activity was assayed using Xylazyme AX (Megazyme, Bray, Co. Wicklow, Ireland) as a substrate in 0.5-mL reactions at 50° C. Activity assays were buffered in sodium phosphate (100 mM, pH 6.5). One miniliter Tris base (2%, w/v) was added to stop the Xylazyme AX reactions. The insoluble material from the Xylazyme AX reaction was sedimented by centrifugation and 100 μL of the supernatant was measured in triplicate spectrophotometrically at 590 nm. Cellulase activity was assayed using Cellazyme tablet (Megazyme, Bray, Co. Wicklow, Ireland) (0.5 mL, 40° C.). Reaction was stopped by adding 10.0 mL of tri-sodium phosphate solution (2% w/v, pH 11.0) and absorbance measured at 590 nm.

Figure 17:
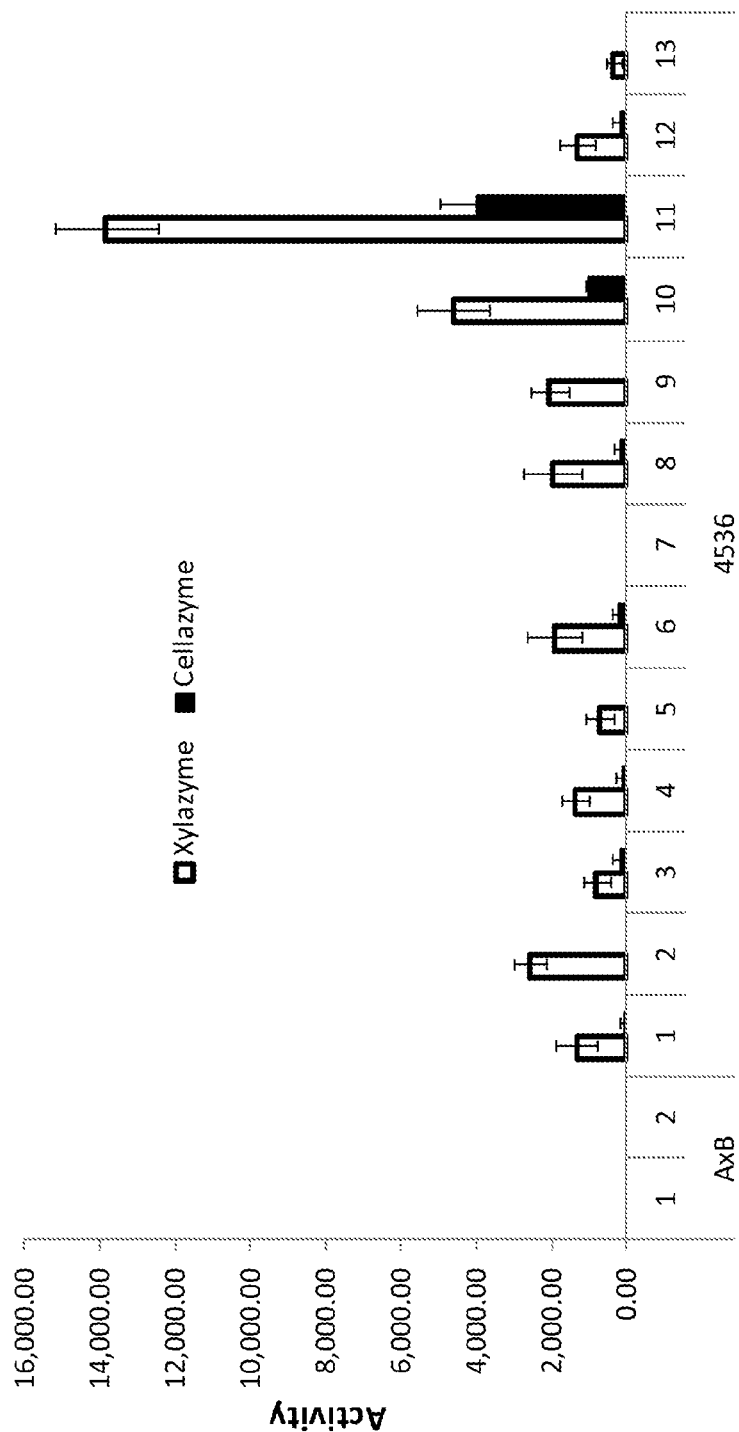
FIG. 17 illustrates xylanase and cellulase activity in transgenic plants expressing a multiprotein unit.

Referring to FIG. 17, both xylanase and cellulase activity were detected in several transgenic events. As expected from maturation of two proteins from a single multiprotein unit, there was a correlation between xylanase and cellulase activity in each transgenic event (referring to events 10 and 11). It was observed that events demonstrating higher xylanase activity usually also showed higher cellulase activity.

REFERENCES

Bonifait L., de la Cruz Dominguez-Punaro M., Vaillancourt K., Bart C., Slater J., Frenette M., Gottschalk M. and Grenier D. (2010) The cell envelope subtilisin-like proteinase is a virulence determinant for *Streptococcus suis*. BMC Microbiology 2010, 10:42.

Davis B. G., Shang X., DeSantis G., Bott R. R., Jones J. B (1999) The controlled introduction of multiple negative charge at single amino acid sites in subtilisin *Bacillus lentus*. Bioorg Med Chem 1999, 7:2293-2301.

Vazquez S. C., Coriab S. H. and Cormackb W. P. M. (2004) Extracellular proteases from eight psychrotolerant antarctic strains Microbiological Research 159:157-166.

The references cited throughout this application are incorporated for all purposes apparent herein and in the references themselves as if each reference was fully set forth. For the sake of presentation, specific ones of these references are cited at particular locations herein. A citation of a reference at a particular location indicates a manner(s) in which the teachings of the reference are incorporated. However, a citation of a reference at a particular location does not limit

SEQUENCE LISTING (238 sequences)

SEQ ID NO: 1 - protein, 380 aa, Bacillus lentus
  MISC_FEATURE (1)..(380): P29600; Pre-proSavinase
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 2 - protein, 483 aa, Clostridium stercorarium
  MISC_FEATURE (1)..(483): P33558 protein
MGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITQWMAGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPTGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 3 - protein, 329 aa, Thermotoga maritima
  MISC_FEATURE (1)..(329): Q7WUM6/AAQ protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIHNDYSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 4 - protein, 337 aa, Dictyoglomus thermophilum
  MISC_FEATURE (1)..(337): P77853 protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 5 - protein, 201 aa, Artificial Sequence
  Synthetic construct, P77853Cd protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFS

SEQ ID NO: 6 - protein, 178 aa, Artificial Sequence
  Synthetic construct, EU591743 protein
MFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVS

SEQ ID NO: 7 - protein, 433 aa, Nasutitermes takasagoensis
  MISC_FEATURE (1)..(433): 077044 (NtEG) protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 8 - protein, 291 aa, Thermomyces lanuginosus
  MISC_FEATURE (1)..(291): O59952 (lipase) protein
MRSSLVLFFVSAWTALASPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCL

SEQ ID NO: 9 - protein, 128 aa, Artificial Sequence
  Synthetic construct, mTth protein
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVLWDPIVAVEPAGKARTFDLRVPPFANFVSEDLVVHN

SEQ ID NO: 10 - protein, 172 aa, Pyrococcus horikoshii OT3
  MISC_FEATURE (1)..(172): Pho_RadA  protein
CFARDTEVYYENDTVPHMESIEEMYSKYASMNGELPFDNGYAVPLDNVFVYTLDIASGEIKKTRASYIYREKVEKLIEIKLSSGYSLKVTPSHPVLLFRDGLQWVPAAEVKPGDVVVGVREEVLRRRIISKGELEFHEVSSVRIIDYNNWVYDLVIPETHNFIAPNGLVLHN

SEQ ID NO: 11 - protein, 482 aa, Thermococcus kodakaraensis KOD1
  MISC_FEATURE (1)..(482): Tko_RadA protein
CFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHN

SEQ ID NO: 12 - protein, 454 aa, Saccharomyces cerevisiae
  MISC_FEATURE (1)..(454): Sce_VMA protein
CFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHN

SEQ ID NO: 13 - protein, 333 aa, Pyrococcus abyssi
  MISC_FEATURE (1)..(333): Pab_Lon protein
CFSGEETVVIRENGEVKVLRLKDFVEKALEKPSGEGLDGDVKVVYHDFRNENVEVLTKDGFTKLLYANKRIGKQKLRRVVNLEKDYWFALTPDHKVYTTDGLKEAGEITEKDELISVPITVFDCEDEDLKKIGLLPLTSDDERLRKIATLMGILFNGGSIDEGLGVLTLKSERSVIEKFVITLKELFGKFEYEIIKEENTILKTRDPRIIKFLVGLGAPIEGKDLKMPWWVKLKPSLFLAFLEGFRAHIVEQLVDDPNKNLPFFQELSWYLGLFGIKADIKVEEVGDKHKIIFDAGRLDVDKQFIETWEDVEVTYNLTTEKGNLLANGLFVKN

SEQ ID NO: 14 - protein, 313 aa, Artificial Sequence
  Synthetic construct, mTth:EU59 protein
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHN

SEQ ID NO: 15 - protein, 349 aa, Artificial sequence
  Synthetic construct, Pho_RadA:EU59, protein
CFARDTEVYYENDTVPHMESIEEMYSKYASMNGELPFDNGYAVPLDNVFVYTLDIASGEIKKTRASYIYREKVEKLIEIKLFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSSSGYSLKVTPSHPVLLFRDGLQWVPAAEVKPGDVVVGVREEVLRRRIISKGELEFHEVSSVRIIDYNNWVYDLVIPETHNFIAPNGLVLHN

SEQ ID NO: 16 - protein, 659 aa, Artificial Sequence
  Synthetic construct, Tko_RadA:EU59 protein
CFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVEFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSLVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHN

SEQ ID NO: 17 - protein, 219 aa, Artificial Sequence
  Synthetic construct, mVMA protein
CFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPRGFYFELQELKEDDYYGITLSDDSDHQFLLANQVVVHN

SEQ ID NO: 18 - protein, 419 aa, Artificial Sequence
  Synthetic construct, mVMA:P77cd protein
CFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHN

SEQ ID NO: 19 - protein, 746 aa, Artificial Sequence
  Synthetic construct, NtEGS109:mTth:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 20 - protein, 746 aa, Artificial Sequence
  Synthetic construct, NtEGT155:mTth:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGECLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 21 - protein, 746 aa, Artificial Sequence
  Synthetic construct, NtEGS255:mTth:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 22 - protein, 746 aa, Artificial Sequence
  Synthetic construct, NtEGS325:mTth:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSACLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 23 - protein, 746 aa, Artificial Sequence
  Synthetic construct, NtEGC348:mTth:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 24 - protein, 746 aa, Artificial Sequence
  Synthetic construct, NtEGS352:mTth:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSNPPTRPHHRSSSCPPAPATCDWNTFNSPDPNYHVLSGALVGGPDQNDNYVDDRSDYVHNEVATDYNAGFQSALAALVALGY

SEQ ID NO: 25 - protein, 746 aa, Artificial Sequence
  Synthetic construct, NtEGS364:mTth:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSCPPAPATCDWNTFNSPDPNYHVLSGALVGGPDQNDNYVDDRSDYVHNEVATDYNAGFQSALAALVALGY

SEQ ID NO: 26 - protein, 746 aa, Artificial Sequence
  Synthetic construct, NtEGT376:mTth:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTFNSPDPNYHVLSGALVGGPDQNDNYVDDRSDYVHNEVATDYNAGFQSALAALVALGY

SEQ ID NO: 27 - protein, 746 aa, Artificial Sequence
  Synthetic construct, NtEGS379:mTth:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSPDPNYHVLSGALVGGPDQNDNYVDDRSDYVHNEVATDYNAGFQSALAALVALGY

SEQ ID NO: 28 - protein, 796 aa, Artificial Sequence
  Synthetic construct, P33S231:mTth:EU59 protein
MGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITQWMAGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSTNSSTLQVIGTPNNGRGIGYIENGNTVTYSNIDFGSGATGFSATVATEVNTSIQIRSDSPTGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 29 - protein, 796 aa, Artificial Sequence
  Synthetic construct, P33S235:mTth:EU59 protein
MGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITQWMAGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSTLQVIGTPNNGRGIGYIENGNTVTYSNIDFGSGATGFSATVATEVNTSIQIRSDSPTGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 30 - protein, 796 aa, Artificial Sequence
  Synthetic construct, P33S303:mTth:EU59 protein
MGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITQWMAGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPTGTLLGTLYVSCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 31 - protein, 796 aa, Artificial Sequence
  Synthetic construct, P33S318:mTth:EU59 protein
MGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITQWMAGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPTGTLLGTLYVSSTGSWNTYQTVSTNICLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSKITGVHDIVLVFSGPVNVDNFIFSRSSPVPAPGDNTRDAYSIIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 32 - protein, 642 aa, Artificial Sequence
  Synthetic construct, AAQS121:mTth:EU59 protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSHFKGRVKIWDVVNEAVSDSGTYRESVWYKTIGPEYIEKAFRWAKEADPDAILIHNDYSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 33 - protein, 642 aa, Artificial Sequence
  Synthetic construct, AAQS138:mTth:EU59 protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSDSGTYRESVWYKTIGPEYIEKAFRWAKEADPDAILIHNDYSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 34 - protein, 642 aa, Artificial Sequence
  Synthetic construct, AAQS140:mTth:EU59 protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSGTYRESVWYKTIGPEYIEKAFRWAKEADPDAILIHNDYSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 35 - protein, 642 aa, Artificial Sequence
  Synthetic construct, AAQS146:mTth:EU59 protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRECLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSVWYKTIGPEYIEKAFRWAKEADPDAILIHNDYSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 36 - protein, 642 aa, Artificial Sequence
  Synthetic construct, AAQS179:mTth:EU59 protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIHNDYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 37 - protein, 642 aa, Artificial Sequence
  Synthetic construct, AAQS187:mTth:EU59 protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIHNDYSIEEINAKCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 38 - protein, 642 aa, Artificial Sequence
  Synthetic construct, AAQS222:mTth:EU59 protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIHNDYSIEEINAKSNFVYNMIKELKEKGVPVDGIGFQMHIDYRGLNYDCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 39 - protein, 642 aa, Artificial Sequence
  Synthetic construct, AAQS249:mTth:EU59 protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIHNDYSIEEINAKSNFVYNMIKELKEKGVPVDGIGFQMHIDYRGLNYDSFRRNLERFAKLGLQIYITEMDVRIPLCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSGSEEYYLKKQAEVCAKIFDICLDNPAVKAIQFWGFTDKYSWVPGFFKGYGKALLFDENYNPKPCYYAIKEVLEKKIEERK

SEQ ID NO: 40 - protein, 642 aa, Artificial Sequence
  Synthetic construct, AAQS251:mTth:EU59 protein
MSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIHNDYSIEEINAKSNFVYNMIKELKEKGVPVDGIGFQMHIDYRGLNYDSFRRNLERFAKLGLQIYITEMDVRIPLSGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSEEYYLKKQAEVCAKIFDICLDNPAVKAIQFWGFTDKYSWVPGFFKGYGKALLFDENYNPKPCYYAIKEVLEKKIEERK

SEQ ID NO: 41 - protein, 746 aa, Artificial Sequence
  Synthetic construct, NtEGS352:mTth-c:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGALAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHASNPPTRPHHRSSSCPPAPATCDWNTFNSPDPNYHVLSGALVGGPDQNDNYVDDRSDYVHNEVATDYNAGFQSALAALVALGY

SEQ ID NO: 42 - protein, 746 aa, Artificial Sequence
  Synthetic construct, NtEGS364:mTth-c:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSALAEGSLVLDAATGQRVPIEKVRPGMEVFSLGPDYRLYRVPVLEVLESGVREVVRLRTRSGRTLVLTPDHPLLTPEGWKPLCDLPLGTPIAVFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHASCPPAPATCDWNTFNSPDPNYHVLSGALVGGPDQNDNYVDDRSDYVHNEVATDYNAGFQSALAALVALGY

SEQ ID NO: 43 - protein, 782 aa, Artificial Sequence
  Synthetic construct, NtEGS149:Pho_RadA:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGCFARDTEVYYENDTVPHMESIEEMYSKYASMNGELPFDNGYAVPLDNVFVYTLDIASGEIKKTRASYIYREKVEKLIEIKLFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSSSGYSLKVTPSHPVLLFRDGLQWVPAAEVKPGDVVVGVREEVLRRRIISKGELEFHEVSSVRIIDYNNWVYDLVIPETHNFIAPNGLVLHNSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 44 - protein, 782 aa, Artificial Sequence
  Synthetic construct, NtEGT179:Pho_RadA:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLCFARDTEVYYENDTVPHMESIEEMYSKYASMNGELPFDNGYAVPLDNVFVYTLDIASGEIKKTRASYIYREKVEKLIEIKLFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSSSGYSLKVTPSHPVLLFRDGLQWVPAAEVKPGDVVVGVREEVLRRRIISKGELEFHEVSSVRIIDYNNWVYDLVIPETHNFIAPNGLVLHNTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 45 - protein, 782 aa, Artificial Sequence
  Synthetic construct, NtEGT200:Pho_RadA:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSICFARDTEVYYENDTVPHMESIEEMYSKYASMNGELPFDNGYAVPLDNVFVYTLDIASGEIKKTRASYIYREKVEKLIEIKLFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSSSGYSLKVTPSHPVLLFRDGLQWVPAAEVKPGDVVVGVREEVLRRRIISKGELEFHEVSSVRIIDYNNWVYDLVIPETHNFIAPNGLVLHNTDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 46 - protein, 782 aa, Artificial Sequence
  Synthetic cosntruct, NtEGS352:Pho_RadA:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGCFARDTEVYYENDTVPHMESIEEMYSKYASMNGELPFDNGYAVPLDNVFVYTLDIASGEIKKTRASYIYREKVEKLIEIKLFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSSSGYSLKVTPSHPVLLFRDGLQWVPAAEVKPGDVVVGVREEVLRRRIISKGELEFHEVSSVRIIDYNNWVYDLVIPETHNFIAPNGLVLHNSNPPTRPHHRSSSCPPAPATCDWNTFNSPDPNYHVLSGALVGGPDQNDNYVDDRSDYVHNEVATDYNAGFQSALAALVALGY

SEQ ID NO: 47 - protein, 1092 aa, Artificial Sequence
  Synthetic construct, NtEGS149:Tko_RadA:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVEFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSLVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 48 - protein, 1092 aa, Artificial Sequence
  Synthetic construct, NtEGT179:Tko_RadA:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVEFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSLVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 49 - protein, 1092 aa, Artificial Sequence
  Synthetic construct, NtEGT200:Tko_RadA:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSICFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVEFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSLVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNTDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 50 - protein, 1092 aa, Artificial Sequence
  Synthetic construct, NtEGS352:Tko_RadA:EU59 protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVEFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSLVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNSNPPTRPHHRSSSCPPAPATCDWNTFNSPDPNYHVLSGALVGGPDQNDNYVDDRSDYVHNEVATDYNAGFQSALAALVALGY

SEQ ID NO: 51 - protein, 799 aa, Artificial Sequence
  Synthetic construct, iproSavS135:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 52 - protein, 799 aa, Artificial Sequence
  Synthetic construct, iproSavS265:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 53 - protein, 799 aa, Artificial Sequence
  Synthetic construct, iproSavS269:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 54 - protein, 799 aa, Artificial Sequence
  Synthetic construct, iproSavS293:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 55 - protein, 799 aa, Artificial Sequence
  Synthetic construct, iproSavS312:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSTYPGSTYASLNGTSMATPHVAGAAALVKQKNPSWSNVQIRNHLKNTATSLGSTNLYGSGLVNAEAATR

SEQ ID NO: 56 - protein, 799 aa, Artificial Sequence
  Synthetic construct, iproSavS317:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSTYASLNGTSMATPHVAGAAALVKQKNPSWSNVQIRNHLKNTATSLGSTNLYGSGLVNAEAATR

SEQ ID NO: 57 - protein, 799 aa, Artificial Sequence
  Synthetic construct, iproSavS326:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSMATPHVAGAAALVKQKNPSWSNVQIRNHLKNTATSLGSTNLYGSGLVNAEAATR

SEQ ID NO: 58 - DNA, 1143 bp, Bacillus lentus
  misc_feature (1)..(1143): P29600; pre-proSavinse
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 59 - DNA, 1452 bp, Clostridium stercorarium
  misc_feature (1)..(1452): P33558 (P33) DNA
atgggtcggattatctatgataacgagacaggtacacatggaggctatgattacgaattgtggaaagactatggcaataccattatggagctgaacgatggcgggaccttctcctgccagtggagtaacattggcaatgcactctttcgtaagggcaggaagttcaattccgataagacgtaccaggaactcggcgacattgtggtcgagtatgggtgtgattacaaccccaatggcaacagctacctttgcgtctatggatggaccagaaaccccctcgtggaatactacatagttgagtcttggggatcatggcgcccacccggtgcgacccctaaaggcacgattacacagtggatggctgggacatacgaaatctatgaaactacacgcgtgaatcaaccgtcaatcgatggtacggccactttccaacagtattggtccgttaggacctctaagcggacttccggcactatctcggtgacggagcacttcaagcagtgggagaggatgggtatgaggatgggaaagatgtacgaggtggcgctgaccgtggaggggtatcagtcatcaggatacgcaaatgtctataagaacgaaatacgcattggggctaaccctaccccagcacctagccagtcacccattagacgcgacgcgttctcgatcatcgaggccgaagaatacaattctacgaacagctctaccctgcaagtgattggaactccaaacaacggaaggggcatcggctacatagaaaacgggaatacagttacttactccaacattgacttcggctccggcgctaccggattctccgctaccgtcgcaacagaggtcaatacgtcaatccagatacggtctgactcccctactggcacgctgcttggcactctctacgtgtcgagtacagggtcgtggaacacgtaccaaaccgtgtccaccaacataagcaagatcactggtgttcatgacattgtgctggtcttttcaggcccggtgaacgttgacaatttcatattctcacggtcctccccggttcctgccccaggcgacaacacacgtgatgcgtactcaatcattcaagcggaggattacgactctagctatggtcccaatcttcaaatctttagtctccctggcggaggttccgccatcggttacatagagaatgggtattctacgacatacaaaaacatcgatttcggcgacggcgcgactagcgtcaccgcaagagtggcaacgcagaacgccacaacgatccaagttcgcttgggaagcccgagtggcaccctgctcgggaccatatacgtcggaagcacgggctctttcgacacatacagagatgtgagcgccactatttcgaatacggctggtgtcaaggacatcgtgctcgtctttagcgggccagtcaacgtggattggttcgtgtttagtaagtcagggacctga

SEQ ID NO: 60 - DNA, 990 bp, Thermotoga maritima
  misc_feature (1)..(990): Q7WUM6 (AAQ) DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttctcactttaaaggtcgtgtgaaaatctgggatgtggttaacgaagccgttagtgatagcggcacctatcgcgaaagtgtgtggtacaaaacgattggtccggaatacatcgaaaaagcgttccgttgggcaaaagaagcggatccggatgccatcctgatccataacgattacagtatcgaagaaatcaacgccaaaagcaacttcgtttacaacatgatcaaagaactgaaagaaaaaggcgtgccggttgatggcattggtttccagatgcacatcgattatcgtggtctgaattacgatagctttcgtcgcaacctggaacgcttcgcaaaactgggcctgcagatttatatcaccgaaatggatgtgcgcattccgctgtctggtagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 61 - DNA, 1014 bp, Dictyoglomus thermophilum
  misc_feature (1)..(1014): P77853 (P77) DNA
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 62 - DNA, 606 bp, Artificial Sequence
  Synthetic construct, P77853cd (P77Cd) DNA
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctcttag

SEQ ID NO: 63 - DNA, 537 bp, Artificial Sequence
  Synthetic construct, EU591743 (EU59) DNA
atgttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatga

SEQ ID NO: 64 - DNA, 1302 bp, Nasutitermes takasagoensis
  misc_feature (1)..(1302): O77044 (NtEG) DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 65 - DNA, 873 bp, Thermomyces lanuginosus
  misc_feature (1)..(873): O59952 (lipase) DNA
atgaggagctcccttgtgctgttctttgtctctgcgtggacggccttggccagtcctattcgtcgagaggtctcgcaggatctgtttaaccagttcaatctctttgcacagtattctgcagccgcatactgcggaaaaaacaatgatgccccagctggtacaaacattacgtgcacgggaaatgcctgccccgaggtagagaaggcggatgcaacgtttctctactcgtttgaagactctggagtgggcgatgtcaccggcttccttgctctcgacaacacgaacaaattgatcgtcctctctttccgtggctctcgttccatagagaactggatcgggaatcttaacttcgacttgaaagaaataaatgacatttgctccggctgcaggggacatgacggcttcacttcgtcctggaggtctgtagccgatacgttaaggcagaaggtggaggatgctgtgagggagcatcccgactatcgcgtggtgtttaccggacatagcttgggtggtgcattggcaactgttgccggagcagacctgcgtggaaatgggtatgatatcgacgtgttttcatatggcgccccccgagtcggaaacagggcttttgcagaattcctgaccgtacagaccggcggaacactctaccgcattacccacaccaatgatattgtccctagactcccgccgcgcgaattcggttacagccattctagcccagagtactggatcaaatctggaacccttgtccccgtcacccgaaacgatatcgtgaagatagaaggcatcgatgccaccggcggcaataaccagcctaacattccggatatccctgcgcacctatggtacttcgggttaattgggacatgtctt

SEQ ID NO: 66 - DNA, 384 bp, Artificial Sequence
  Synthetic construct, mTth DNA
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcctctgggaccctattgttgctgtcgaaccggccggtaaggcgagaacattcgacttgcgcgttccaccctttgcaaacttcgtgagcgaggacctggtggtgcataac

SEQ ID NO: 67 - DNA, 516 bp, Pyrococcus horikoshii OT3
  misc_feature (1)..(516): Pho_RadA DNA
tgcttcgctagggatacggaggtttactacgagaatgacacagttccgcacatggagtcaatcgaggagatgtactcaaagtacgcttccatgaacggcgagctcccgttcgacaatgggtacgcggtcccactcgataacgtgttcgtctacaccctggacatcgctagcggcgagattaagaagacgcgcgcctcgtacatctacagggagaaggtggagaagctcatcgagattaagctgtccagcggctactcactcaaggttacaccatcccacccagtgctcctgttccgggatgggctgcagtgggtgccagctgctgaggtcaagcctggcgacgtggtcgttggggtccgcgaggaggttctcaggaggcggatcatttccaagggcgagctggagttccatgaggtttcgtctgtgaggatcattgattacaacaattgggtctacgatctcgtcattccagagactcataacttcattgctccaaatgggctcgtgctccacaac

SEQ ID NO: 68 - DNA, 1446 bp, Thermococcus kodakaraensis KOD1
  misc_feature (1)..(1446): Tko_RadA DNA
tgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaac

SEQ ID NO: 69 - DNA, 1362 bp, Saccharomyces cerevisiae
  misc_feature (1)..(1362): Sca_VMA DNA
  misc_feature (1)..(1362): Sce_VMA DNA
tgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataat

SEQ ID NO: 70 - DNA, 999 bp, Pyrococcus abyssi
  misc_feature (1)..(999): Pab_Lon DNA
tgcttcagcggggaggagacagtcgttattcgggagaatggggaggtcaaggtgctcaggctcaaggatttcgtggagaaggctctggagaagccaagcggcgaggggctggacggcgatgtgaaggtggtctaccacgacttccgcaacgagaatgtcgaggttctcaccaaggatggcttcacgaagctcctgtacgctaacaagaggatcgggaagcagaagctccgcagggttgtgaatctggagaaggactactggttcgctctcacccccgaccataaggtctacaccacggatggcctgaaggaggccggggagatcacagagaaggacgagctcatctctgtcccaattactgttttcgattgcgaggacgaggatctgaagaagatcggcctcctgcctctcacctcggacgatgagcggctgcgcaagatcgccacgctcatgggcattctgttcaacggcgggtctatcgacgagggcctcggggtgctcacactgaagtccgagaggagcgttatcgagaagttcgtgattaccctcaaggagctgttcggcaagttcgagtacgagatcattaaggaggagaacacaatcctgaagactagggacccgcggatcattaagttcctcgtcggcctgggggctccaattgagggcaaggatctcaagatgccatggtgggttaagctgaagccttcactcttcctggccttcctggagggcttccgggctcacatcgtggagcagctggtcgacgatccgaacaagaatctccccttcttccaggagctgtcctggtacctcggcctgttcgggatcaaggcggacattaaggttgaggaagtgggcgacaagcataagatcattttcgatgctgggcgcctcgacgtcgataagcagttcatcgagacgtgggaggacgtggaggtcacctacaacctcactacggagaagggcaatctgctcgccaatgggctcttcgttaagaac

SEQ ID NO: 71 - DNA, 939 bp, Artificial Sequence
  Synthetic construct, mTth:EU59 DNA
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataac

SEQ ID NO: 72 - DNA, 1047 bp, Artificial Sequence
  Synthetic construct, Pho_RadA:EU59 DNA
tgcttcgctagggatacggaggtttactacgagaatgacacagttccgcacatggagtcaatcgaggagatgtactcaaagtacgcttccatgaacggcgagctcccgttcgacaatgggtacgcggtcccactcgataacgtgttcgtctacaccctggacatcgctagcggcgagattaagaagacgcgcgcctcgtacatctacagggagaaggtggagaagctcatcgagattaagctgttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatccagcggctactcactcaaggttacaccatcccacccagtgctcctgttccgggatgggctgcagtgggtgccagctgctgaggtcaagcctggcgacgtggtcgttggggtccgcgaggaggttctcaggaggcggatcatttccaagggcgagctggagttccatgaggtttcgtctgtgaggatcattgattacaacaattgggtctacgatctcgtcattccagagactcataacttcattgctccaaatgggctcgtgctccacaac

SEQ ID NO: 73 - DNA, 1977 bp, Artificial Sequence
  Synthetic construct, Tko_RadA:EU59 DNA
tgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcactggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaac

SEQ ID NO: 74 - DNA, 657 bp, Artificial Sequence
  Synthetic construct, mVMA DNA
tgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacgcggattttatttcgagttacaagaattgaaggaagacgattattatgggattactttatctgatgattctgatcatcagtttttgcttgccaaccaggttgtcgtccataat

SEQ ID NO: 75 - DNA, 1257 bp, Artificial Sequence
  Synthetic construct, mVMA:P77cd DNA
tgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataat

SEQ ID NO: 76 - DNA, 2241 bp, Artificial Sequence
  Synthetic construct, NtEGS109:mTth:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 77 - DNA, 2241 bp, Artificial Sequence
  Synthetic construct, NtEGT155:mTth:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 78 - DNA, 2241 bp, Artificial Sequence
  Synthetic construct, NtEGS255:mTth:EU59  DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 79 - DNA, 2241 bp, Artificial Sequence
  Synthetic construct, NtEGS325:mTth:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 80 - DNA, 2241 bp, Artificial Sequence
  Synthetic construct, NtEGC348:mTth:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 81 - DNA, 2241 bp, Artificial Sequence
  Synthetic construct, NtEGS352:mTth:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 82 - DNA, 2241 bp, Artificial Sequence
  Synthetic construct, NtEGS364:mTth:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 83 - DNA, 2241 bp, Artificial Sequence
  Synthetic construct, NtEGT376:mTth:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 84 - DNA, 2241 bp, Artificial Sequence
  Synthetic construct, NtEGS379:mTth:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 85 - DNA, 2391 bp, Artificial Sequence
  Synthetic construct, P33S231:mTth:EU59 DNA
atgggtcggattatctatgataacgagacaggtacacatggaggctatgattacgaattgtggaaagactatggcaataccattatggagctgaacgatggcgggaccttctcctgccagtggagtaacattggcaatgcactctttcgtaagggcaggaagttcaattccgataagacgtaccaggaactcggcgacattgtggtcgagtatgggtgtgattacaaccccaatggcaacagctacctttgcgtctatggatggaccagaaaccccctcgtggaatactacatagttgagtcttggggatcatggcgcccacccggtgcgacccctaaaggcacgattacacagtggatggctgggacatacgaaatctatgaaactacacgcgtgaatcaaccgtcaatcgatggtacggccactttccaacagtattggtccgttaggacctctaagcggacttccggcactatctcggtgacggagcacttcaagcagtgggagaggatgggtatgaggatgggaaagatgtacgaggtggcgctgaccgtggaggggtatcagtcatcaggatacgcaaatgtctataagaacgaaatacgcattggggctaaccctaccccagcacctagccagtcacccattagacgcgacgcgttctcgatcatcgaggccgaagaatacaattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactctacgaacagctctaccctgcaagtgattggaactccaaacaacggaaggggcatcggctacatagaaaacgggaatacagttacttactccaacattgacttcggctccggcgctaccggattctccgctaccgtcgcaacagaggtcaatacgtcaatccagatacggtctgactcccctactggcacgctgcttggcactctctacgtgtcgagtacagggtcgtggaacacgtaccaaaccgtgtccaccaacataagcaagatcactggtgttcatgacattgtgctggtcttttcaggcccggtgaacgttgacaatttcatattctcacggtcctccccggttcctgccccaggcgacaacacacgtgatgcgtactcaatcattcaagcggaggattacgactctagctatggtcccaatcttcaaatctttagtctccctggcggaggttccgccatcggttacatagagaatgggtattctacgacatacaaaaacatcgatttcggcgacggcgcgactagcgtcaccgcaagagtggcaacgcagaacgccacaacgatccaagttcgcttgggaagcccgagtggcaccctgctcgggaccatatacgtcggaagcacgggctctttcgacacatacagagatgtgagcgccactatttcgaatacggctggtgtcaaggacatcgtgctcgtctttagcgggccagtcaacgtggattggttcgtgtttagtaagtcagggacctga

SEQ ID NO: 86 - DNA, 2391 bp, Artificial Sequence
  Synthetic construct, P33S235:mTth:EU59 DNA
atgggtcggattatctatgataacgagacaggtacacatggaggctatgattacgaattgtggaaagactatggcaataccattatggagctgaacgatggcgggaccttctcctgccagtggagtaacattggcaatgcactctttcgtaagggcaggaagttcaattccgataagacgtaccaggaactcggcgacattgtggtcgagtatgggtgtgattacaaccccaatggcaacagctacctttgcgtctatggatggaccagaaaccccctcgtggaatactacatagttgagtcttggggatcatggcgcccacccggtgcgacccctaaaggcacgattacacagtggatggctgggacatacgaaatctatgaaactacacgcgtgaatcaaccgtcaatcgatggtacggccactttccaacagtattggtccgttaggacctctaagcggacttccggcactatctcggtgacggagcacttcaagcagtgggagaggatgggtatgaggatgggaaagatgtacgaggtggcgctgaccgtggaggggtatcagtcatcaggatacgcaaatgtctataagaacgaaatacgcattggggctaaccctaccccagcacctagccagtcacccattagacgcgacgcgttctcgatcatcgaggccgaagaatacaattctacgaacagctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactctaccctgcaagtgattggaactccaaacaacggaaggggcatcggctacatagaaaacgggaatacagttacttactccaacattgacttcggctccggcgctaccggattctccgctaccgtcgcaacagaggtcaatacgtcaatccagatacggtctgactcccctactggcacgctgcttggcactctctacgtgtcgagtacagggtcgtggaacacgtaccaaaccgtgtccaccaacataagcaagatcactggtgttcatgacattgtgctggtcttttcaggcccggtgaacgttgacaatttcatattctcacggtcctccccggttcctgccccaggcgacaacacacgtgatgcgtactcaatcattcaagcggaggattacgactctagctatggtcccaatcttcaaatctttagtctccctggcggaggttccgccatcggttacatagagaatgggtattctacgacatacaaaaacatcgatttcggcgacggcgcgactagcgtcaccgcaagagtggcaacgcagaacgccacaacgatccaagttcgcttgggaagcccgagtggcaccctgctcgggaccatatacgtcggaagcacgggctctttcgacacatacagagatgtgagcgccactatttcgaatacggctggtgtcaaggacatcgtgctcgtctttagcgggccagtcaacgtggattggttcgtgtttagtaagtcagggacctga

SEQ ID NO: 87 - DNA, 2391 bp, Artificial Sequence
  Synthetic construct, P33S303:mTth:EU59 DNA
atgggtcggattatctatgataacgagacaggtacacatggaggctatgattacgaattgtggaaagactatggcaataccattatggagctgaacgatggcgggaccttctcctgccagtggagtaacattggcaatgcactctttcgtaagggcaggaagttcaattccgataagacgtaccaggaactcggcgacattgtggtcgagtatgggtgtgattacaaccccaatggcaacagctacctttgcgtctatggatggaccagaaaccccctcgtggaatactacatagttgagtcttggggatcatggcgcccacccggtgcgacccctaaaggcacgattacacagtggatggctgggacatacgaaatctatgaaactacacgcgtgaatcaaccgtcaatcgatggtacggccactttccaacagtattggtccgttaggacctctaagcggacttccggcactatctcggtgacggagcacttcaagcagtgggagaggatgggtatgaggatgggaaagatgtacgaggtggcgctgaccgtggaggggtatcagtcatcaggatacgcaaatgtctataagaacgaaatacgcattggggctaaccctaccccagcacctagccagtcacccattagacgcgacgcgttctcgatcatcgaggccgaagaatacaattctacgaacagctctaccctgcaagtgattggaactccaaacaacggaaggggcatcggctacatagaaaacgggaatacagttacttactccaacattgacttcggctccggcgctaccggattctccgctaccgtcgcaacagaggtcaatacgtcaatccagatacggtctgactcccctactggcacgctgcttggcactctctacgtgtcgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtacagggtcgtggaacacgtaccaaaccgtgtccaccaacataagcaagatcactggtgttcatgacattgtgctggtcttttcaggcccggtgaacgttgacaatttcatattctcacggtcctccccggttcctgccccaggcgacaacacacgtgatgcgtactcaatcattcaagcggaggattacgactctagctatggtcccaatcttcaaatctttagtctccctggcggaggttccgccatcggttacatagagaatgggtattctacgacatacaaaaacatcgatttcggcgacggcgcgactagcgtcaccgcaagagtggcaacgcagaacgccacaacgatccaagttcgcttgggaagcccgagtggcaccctgctcgggaccatatacgtcggaagcacgggctctttcgacacatacagagatgtgagcgccactatttcgaatacggctggtgtcaaggacatcgtgctcgtctttagcgggccagtcaacgtggattggttcgtgtttagtaagtcagggacctga

SEQ ID NO: 88 - DNA, 2391 bp, Artificial Sequence
  Synthetic construct, P33S318:mTth:EU59 DNA
atgggtcggattatctatgataacgagacaggtacacatggaggctatgattacgaattgtggaaagactatggcaataccattatggagctgaacgatggcgggaccttctcctgccagtggagtaacattggcaatgcactctttcgtaagggcaggaagttcaattccgataagacgtaccaggaactcggcgacattgtggtcgagtatgggtgtgattacaaccccaatggcaacagctacctttgcgtctatggatggaccagaaaccccctcgtggaatactacatagttgagtcttggggatcatggcgcccacccggtgcgacccctaaaggcacgattacacagtggatggctgggacatacgaaatctatgaaactacacgcgtgaatcaaccgtcaatcgatggtacggccactttccaacagtattggtccgttaggacctctaagcggacttccggcactatctcggtgacggagcacttcaagcagtgggagaggatgggtatgaggatgggaaagatgtacgaggtggcgctgaccgtggaggggtatcagtcatcaggatacgcaaatgtctataagaacgaaatacgcattggggctaaccctaccccagcacctagccagtcacccattagacgcgacgcgttctcgatcatcgaggccgaagaatacaattctacgaacagctctaccctgcaagtgattggaactccaaacaacggaaggggcatcggctacatagaaaacgggaatacagttacttactccaacattgacttcggctccggcgctaccggattctccgctaccgtcgcaacagaggtcaatacgtcaatccagatacggtctgactcccctactggcacgctgcttggcactctctacgtgtcgagtacagggtcgtggaacacgtaccaaaccgtgtccaccaacatatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcaagatcactggtgttcatgacattgtgctggtcttttcaggcccggtgaacgttgacaatttcatattctcacggtcctccccggttcctgccccaggcgacaacacacgtgatgcgtactcaatcattcaagcggaggattacgactctagctatggtcccaatcttcaaatctttagtctccctggcggaggttccgccatcggttacatagagaatgggtattctacgacatacaaaaacatcgatttcggcgacggcgcgactagcgtcaccgcaagagtggcaacgcagaacgccacaacgatccaagttcgcttgggaagcccgagtggcaccctgctcgggaccatatacgtcggaagcacgggctctttcgacacatacagagatgtgagcgccactatttcgaatacggctggtgtcaaggacatcgtgctcgtctttagcgggccagtcaacgtggattggttcgtgtttagtaagtcagggacctga

SEQ ID NO: 89 - DNA, 1929 bp, Artificial Sequence
  Synthetic construct, AAQS121:mTth:EU59 DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactctcactttaaaggtcgtgtgaaaatctgggatgtggttaacgaagccgttagtgatagcggcacctatcgcgaaagtgtgtggtacaaaacgattggtccggaatacatcgaaaaagcgttccgttgggcaaaagaagcggatccggatgccatcctgatccataacgattacagtatcgaagaaatcaacgccaaaagcaacttcgtttacaacatgatcaaagaactgaaagaaaaaggcgtgccggttgatggcattggtttccagatgcacatcgattatcgtggtctgaattacgatagctttcgtcgcaacctggaacgcttcgcaaaactgggcctgcagatttatatcaccgaaatggatgtgcgcattccgctgtctggtagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 90 - DNA, 1929 bp, Artificial Sequence
  Synthetic construct, AAQS138:mTth:EU59 DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttctcactttaaaggtcgtgtgaaaatctgggatgtggttaacgaagccgtttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtgatagcggcacctatcgcgaaagtgtgtggtacaaaacgattggtccggaatacatcgaaaaagcgttccgttgggcaaaagaagcggatccggatgccatcctgatccataacgattacagtatcgaagaaatcaacgccaaaagcaacttcgtttacaacatgatcaaagaactgaaagaaaaaggcgtgccggttgatggcattggtttccagatgcacatcgattatcgtggtctgaattacgatagctttcgtcgcaacctggaacgcttcgcaaaactgggcctgcagatttatatcaccgaaatggatgtgcgcattccgctgtctggtagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 91 - DNA, 1929 bp, Artificial Sequence
  Synthetic construct, AAQS140:mTth:EU59 DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttctcactttaaaggtcgtgtgaaaatctgggatgtggttaacgaagccgttagtgattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcggcacctatcgcgaaagtgtgtggtacaaaacgattggtccggaatacatcgaaaaagcgttccgttgggcaaaagaagcggatccggatgccatcctgatccataacgattacagtatcgaagaaatcaacgccaaaagcaacttcgtttacaacatgatcaaagaactgaaagaaaaaggcgtgccggttgatggcattggtttccagatgcacatcgattatcgtggtctgaattacgatagctttcgtcgcaacctggaacgcttcgcaaaactgggcctgcagatttatatcaccgaaatggatgtgcgcattccgctgtctggtagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 92 - DNA, 1929 bp, Artificial Sequence
  Synthetic construct,AAQS146:mTth:EU59 DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttctcactttaaaggtcgtgtgaaaatctgggatgtggttaacgaagccgttagtgatagcggcacctatcgcgaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtgtgtggtacaaaacgattggtccggaatacatcgaaaaagcgttccgttgggcaaaagaagcggatccggatgccatcctgatccataacgattacagtatcgaagaaatcaacgccaaaagcaacttcgtttacaacatgatcaaagaactgaaagaaaaaggcgtgccggttgatggcattggtttccagatgcacatcgattatcgtggtctgaattacgatagctttcgtcgcaacctggaacgcttcgcaaaactgggcctgcagatttatatcaccgaaatggatgtgcgcattccgctgtctggtagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 93 - DNA, 1929 bp, Artificial Sequence
  Synthetic construct, AAQS179:mTth:EU59 DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttctcactttaaaggtcgtgtgaaaatctgggatgtggttaacgaagccgttagtgatagcggcacctatcgcgaaagtgtgtggtacaaaacgattggtccggaatacatcgaaaaagcgttccgttgggcaaaagaagcggatccggatgccatcctgatccataacgattactgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtatcgaagaaatcaacgccaaaagcaacttcgtttacaacatgatcaaagaactgaaagaaaaaggcgtgccggttgatggcattggtttccagatgcacatcgattatcgtggtctgaattacgatagctttcgtcgcaacctggaacgcttcgcaaaactgggcctgcagatttatatcaccgaaatggatgtgcgcattccgctgtctggtagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 94 - DNA, 1929 bp, Artificial Sequence
  Synthetic construct, AAQS187:mTth:EU59 DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttctcactttaaaggtcgtgtgaaaatctgggatgtggttaacgaagccgttagtgatagcggcacctatcgcgaaagtgtgtggtacaaaacgattggtccggaatacatcgaaaaagcgttccgttgggcaaaagaagcggatccggatgccatcctgatccataacgattacagtatcgaagaaatcaacgccaaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcaacttcgtttacaacatgatcaaagaactgaaagaaaaaggcgtgccggttgatggcattggtttccagatgcacatcgattatcgtggtctgaattacgatagctttcgtcgcaacctggaacgcttcgcaaaactgggcctgcagatttatatcaccgaaatggatgtgcgcattccgctgtctggtagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 95 - DNA, 1929 bp, Artificial Sequence
  Synthetic construct, AAQS222:mTth:EU59 DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttctcactttaaaggtcgtgtgaaaatctgggatgtggttaacgaagccgttagtgatagcggcacctatcgcgaaagtgtgtggtacaaaacgattggtccggaatacatcgaaaaagcgttccgttgggcaaaagaagcggatccggatgccatcctgatccataacgattacagtatcgaagaaatcaacgccaaaagcaacttcgtttacaacatgatcaaagaactgaaagaaaaaggcgtgccggttgatggcattggtttccagatgcacatcgattatcgtggtctgaattacgattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagctttcgtcgcaacctggaacgcttcgcaaaactgggcctgcagatttatatcaccgaaatggatgtgcgcattccgctgtctggtagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 96 - DNA, 1929 bp, Artificial Sequence
  Synthetic construct, AAQS249:mTth:EU59 DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttctcactttaaaggtcgtgtgaaaatctgggatgtggttaacgaagccgttagtgatagcggcacctatcgcgaaagtgtgtggtacaaaacgattggtccggaatacatcgaaaaagcgttccgttgggcaaaagaagcggatccggatgccatcctgatccataacgattacagtatcgaagaaatcaacgccaaaagcaacttcgtttacaacatgatcaaagaactgaaagaaaaaggcgtgccggttgatggcattggtttccagatgcacatcgattatcgtggtctgaattacgatagctttcgtcgcaacctggaacgcttcgcaaaactgggcctgcagatttatatcaccgaaatggatgtgcgcattccgctgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactctggtagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 97 - DNA, 1929 bp, Artificial Sequence
  Synthetic construct, AAQS251:mTth:EU59 DNA
atgagccagaatgtttctctgcgcgaactggcggaaaaactgaacatttacatcggctttgcggccattaacaatttctggagcctgtctgatgcagaaaaatatatggaagtggcgcgtcgcgaatttaatattctgaccccggaaaaccagatgaaatgggatacgatccatccggaacgtgatcgctataattttaccccggccgaaaaacacgttgaattcgcagaagaaaatgatatgattgtgcatggccacacgctggtttggcataaccagctgccgggctggatcaccggtcgtgaatggacgaaagaagaactgctgaatgtgctggaagatcatattaaaaccgtggtttctcactttaaaggtcgtgtgaaaatctgggatgtggttaacgaagccgttagtgatagcggcacctatcgcgaaagtgtgtggtacaaaacgattggtccggaatacatcgaaaaagcgttccgttgggcaaaagaagcggatccggatgccatcctgatccataacgattacagtatcgaagaaatcaacgccaaaagcaacttcgtttacaacatgatcaaagaactgaaagaaaaaggcgtgccggttgatggcattggtttccagatgcacatcgattatcgtggtctgaattacgatagctttcgtcgcaacctggaacgcttcgcaaaactgggcctgcagatttatatcaccgaaatggatgtgcgcattccgctgtctggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtgaagaatattacctgaaaaaacaggcggaagtttgcgccaaaatttttgatatctgtctggataacccggccgtgaaagcaatccagttttggggcttcacggataaatattcttgggttccgggctttttcaaaggctacggtaaagcactgctgttcgatgaaaactataatccgaaaccgtgctattacgcgatcaaagaagtgctggaaaagaaaattgaagaacgtaaataa

SEQ ID NO: 98 - DNA, 2241 bp, Artificial Sequence
  Synthetic construct, NtEGS352:mTth-c:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcggggccctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcatgccagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 99 - DNA, 2241 bp, Artificial Sequence
  Synthetic construct, NtEGS364:mTth-c:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcggccctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcatgcctcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 100 - DNA, 2349 bp, Artificial Sequence
  Synthetic construct, NtEGS149:Pho_RadA:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctgcttcgctagggatacggaggtttactacgagaatgacacagttccgcacatggagtcaatcgaggagatgtactcaaagtacgcttccatgaacggcgagctcccgttcgacaatgggtacgcggtcccactcgataacgtgttcgtctacaccctggacatcgctagcggcgagattaagaagacgcgcgcctcgtacatctacagggagaaggtggagaagctcatcgagattaagctgttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatccagcggctactcactcaaggttacaccatcccacccagtgctcctgttccgggatgggctgcagtgggtgccagctgctgaggtcaagcctggcgacgtggtcgttggggtccgcgaggaggttctcaggaggcggatcatttccaagggcgagctggagttccatgaggtttcgtctgtgaggatcattgattacaacaattgggtctacgatctcgtcattccagagactcataacttcattgctccaaatgggctcgtgctccacaactctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 101 - DNA, 2349 bp, Artificial Sequence
  Synthetic construct, NtEGT179:Pho_RadA:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttatgcttcgctagggatacggaggtttactacgagaatgacacagttccgcacatggagtcaatcgaggagatgtactcaaagtacgcttccatgaacggcgagctcccgttcgacaatgggtacgcggtcccactcgataacgtgttcgtctacaccctggacatcgctagcggcgagattaagaagacgcgcgcctcgtacatctacagggagaaggtggagaagctcatcgagattaagctgttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatccagcggctactcactcaaggttacaccatcccacccagtgctcctgttccgggatgggctgcagtgggtgccagctgctgaggtcaagcctggcgacgtggtcgttggggtccgcgaggaggttctcaggaggcggatcatttccaagggcgagctggagttccatgaggtttcgtctgtgaggatcattgattacaacaattgggtctacgatctcgtcattccagagactcataacttcattgctccaaatgggctcgtgctccacaacacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 102 - DNA, 2349 bp, Artificial Sequence
  Synthetic construct, NtEGT200:Pho_RadA:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctatttgcttcgctagggatacggaggtttactacgagaatgacacagttccgcacatggagtcaatcgaggagatgtactcaaagtacgcttccatgaacggcgagctcccgttcgacaatgggtacgcggtcccactcgataacgtgttcgtctacaccctggacatcgctagcggcgagattaagaagacgcgcgcctcgtacatctacagggagaaggtggagaagctcatcgagattaagctgttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatccagcggctactcactcaaggttacaccatcccacccagtgctcctgttccgggatgggctgcagtgggtgccagctgctgaggtcaagcctggcgacgtggtcgttggggtccgcgaggaggttctcaggaggcggatcatttccaagggcgagctggagttccatgaggtttcgtctgtgaggatcattgattacaacaattgggtctacgatctcgtcattccagagactcataacttcattgctccaaatgggctcgtgctccacaacactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 103 - DNA, 2349 bp, Artificial Sequence
  Synthetic construct, NtEGS352:Pho_RadA:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggtgcttcgctagggatacggaggtttactacgagaatgacacagttccgcacatggagtcaatcgaggagatgtactcaaagtacgcttccatgaacggcgagctcccgttcgacaatgggtacgcggtcccactcgataacgtgttcgtctacaccctggacatcgctagcggcgagattaagaagacgcgcgcctcgtacatctacagggagaaggtggagaagctcatcgagattaagctgttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatccagcggctactcactcaaggttacaccatcccacccagtgctcctgttccgggatgggctgcagtgggtgccagctgctgaggtcaagcctggcgacgtggtcgttggggtccgcgaggaggttctcaggaggcggatcatttccaagggcgagctggagttccatgaggtttcgtctgtgaggatcattgattacaacaattgggtctacgatctcgtcattccagagactcataacttcattgctccaaatgggctcgtgctccacaacagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 104 - DNA, 3279 bp, Artificial Sequence
  Synthetic construct, NtEGS149:Tko_RadA:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcactggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaactctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 105 - DNA, 3279 bp, Artificial Sequence
  Synthetic construct, NtEGT179:Tko_RadA:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttatgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcactggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 106 - DNA, 3279 bp, Artificial Sequence
  Synthetic construct, NtEGT200:Tko_RadA:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctatttgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcactggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 107 - DNA, 3279 bp, Artificial Sequence
  Synthetic construct, NtEGS352:Tko_RadA:EU59 DNA
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcactggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 108 - DNA, 2400 bp, Artificial Sequence
  Synthetic construct, iproSavS135:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 109 - DNA, 2400 bp, Artificial Sequence
  Synthetic construct, iproSavS265:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 110 - DNA, 2400 bp, Artificial Sequence
  Synthetic construct, iproSavS269:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 111 - DNA, 2400 bp, Artificial Sequence
  Synthetic construct, iproSavS293:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataatagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 112 - DNA, 2400 bp, Artificial Sequence
  Synthetic construct, iproSavS312:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagtgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataatagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 113 - DNA, 2400 bp, Artificial Sequence
  Synthetic construct, iproSavS317:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 114 - DNA, 2400 bp, Artificial Sequence
  Synthetic construct, iproSavS326:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 115 - DNA, 14674 bp, Artificial Sequence
  Synthetic construct, pAG4535
ctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctaaaccatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgac

SEQ ID NO: 116 - DNA, 14674 bp, Artificial Sequence
  Synthetic construct, pAG4536
ctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctaaaccatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgac

SEQ ID NO: 117 - DNA, 13972 bp, Artificial Sequence
  Synthetic construct, pAG4537
gatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctaaaccatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccg

SEQ ID NO: 118 - DNA, 13972 bp, Artificial Sequence
  Synthetic construct, pAG4538
gatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctaaaccatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccg

SEQ ID NO: 119 - DNA, 1299 bp, Artificial Sequence
  Synthetic construct Hwa:O59_1
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcagaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggacgttactgattgcctcacaactgacaggatcaccgctgtgaagaccgtcacgccaacagctgagtgggtctacgatctggaggtggagggcacacacgcctacctcacaaacggggttctctcacacaac

SEQ ID NO: 120 - DNA, 1299 bp, Artificial Sequence
  Synthetic construct Hwa:O59_2
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcagaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggacgttactgatgccctcacaactgacaggatcaccgctgtgaagaccgtcacgccaacagctgagtgggtctacgatctggaggtggagggcacacacgcctacctcacaaacggggttctctcacacaac

SEQ ID NO: 121 - DNA, 1314 bp, Artificial Sequence
  Synthetic construct Hwa:O59_3
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcaagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggacgttactgatgccctcacaactgacaggatcaccgctgtgaagaccgtcacgccaacagctgagtgggtctacgatctggaggtggagggcacacacgcctacctcacaaacggggttctctcacacaac

SEQ ID NO: 122 - DNA, 1314 bp, Artificial Sequence
  Synthetic construct Hwa:O59_4
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggtcgccgactcagacgttactgatgccctcacaactgacaggatcaccgctgtgaagaccgtcacgccaacagctgagtgggtctacgatctggaggtggagggcacacacgcctacctcacaaacggggttctctcacacaac

SEQ ID NO: 123 - DNA, 1314 bp, Artificial Sequence
  Synthetic construct Hwa:O59_5
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcagacgttactgatgccagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgctcacaactgacaggatcaccgctgtgaagaccgtcacgccaacagctgagtgggtctacgatctggaggtggagggcacacacgcctacctcacaaacggggttctctcacacaac

SEQ ID NO: 124 - DNA, 1449 bp, Artificial Sequence
  Synthetic construct Hwa:O59_6
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggagagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggacgttactgatgccctcacaactgacaggatcaccgctgtgaagaccgtcacgccaacagctgagtgggtctacgatctggaggtggagggcacacacgcctacctcacaaacggggttctctcacacaac

SEQ ID NO: 125 - DNA, 1449 bp, Artificial Sequence
  Synthetic construct Hwa:O59_7
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcaagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgcacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgatgccctcacaactgacaggatcaccgctgtgaagaccgtcacgccaacagctgagtgggtctacgatctggaggtggagggcacacacgcctacctcacaaacggggttctctcacacaac

SEQ ID NO: 126 - DNA, 1449 bp, Artificial Sequence
  Synthetic construct Hwa:O59_8
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgatgccctcacaactgacaggatcaccgctgtgaagaccgtcacgccaacagctgagtgggtctacgatctggaggtggagggcacacacgcctacctcacaaacggggttctctcacacaac

SEQ ID NO: 127 - DNA, 1449 bp, Artificial Sequence
  Synthetic construct Hwa:O59_9
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgatgccagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgctcacaactgacaggatcaccgctgtgaagaccgtcacgccaacagctgagtgggtctacgatctggaggtggagggcacacacgcctacctcacaaacggggttctctcacacaac

SEQ ID NO: 128 - DNA, 1230 bp, Artificial Sequence
  Synthetic construct mTth:O59_1
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgagagatgttgagactggagaggttctctgggaccctattgttgctgtcgaaccggccggtaaggcgagaacattcgacttgcgcgttccaccctttgcaaacttcgtgagcgaggacctggtggtgcataac

SEQ ID NO: 129 - DNA, 1230 bp, Artificial Sequence
  Synthetic construct mTth:O59_2
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgctctgggaccctattgttgctgtcgaaccggccggtaaggcgagaacattcgacttgcgcgttccaccctttgcaaacttcgtgagcgaggacctggtggtgcataac

SEQ ID NO: 130 - DNA, 1254 bp, Artificial Sequence
  Synthetic construct mTth:O59_3
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgagagatgttgagactggagaggttctctgggaccctattgttgctgtcgaaccggccggtaaggcgagaacattcgacttgcgcgttccaccctttgcaaacttcgtgagcgaggacctggtggtgcataac

SEQ ID NO: 131 - DNA, 1239 bp, Artificial Sequence
  Synthetic construct mTth:O59_4
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgagagatgttgagactggagaggttctctgggaccctattgttgctgtcgaaccggccggtaaggcgagaacattcgacttgcgcgttccaccctttgcaaacttcgtgagcgaggacctggtggtgcataac

SEQ ID NO: 132 - DNA, 1215 bp, Artificial Sequence
  Synthetic construct mTth:O59_5
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgctctgggaccctattgttgctgtcgaaccggccggtaaggcgagaacattcgacttgcgcgttccaccctttgcaaacttcgtgagcgaggacctggtggtgcataac

SEQ ID NO: 133 - DNA, 1215 bp, Artificial Sequence
  Synthetic construct mTth:O59_6
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgagagatgttgagactggagaggttctctgggaccctattgttgctgtcgaaccggccggtaaggcgagaacattcgacttgcgcgttccaccctttgcaaacttcgtgagcgaggacctggtggtgcataac

SEQ ID NO: 134 - protein, 433 aa, Artificial Sequence
  Synthetic construct Hwa:O59_1
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLDVTDCLTTDRITAVKTVTPTAEWVYDLEVEGTHAYLTNGVLSHN

SEQ ID NO: 135 - protein, 433 aa, Artificial Sequence
  Synthetic construct Hwa:O59_2
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLDVTDALTTDRITAVKTVTPTAEWVYDLEVEGTHAYLTNGVLSHN

SEQ ID NO: 136 - protein, 438 aa, Artificial Sequence
  Synthetic construct Hwa:O59_3
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLDVTDALTTDRITAVKTVTPTAEWVYDLEVEGTHAYLTNGVLSHN

SEQ ID NO: 137 - protein, 438 aa, Artificial Sequence
  Synthetic construct Hwa:O59_4
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLVADSDVTDALTTDRITAVKTVTPTAEWVYDLEVEGTHAYLTNGVLSHN

SEQ ID NO: 138 - protein, 438 aa, Artificial Sequence
  Synthetic construct Hwa:O59_5
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSDVTDASPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLLTTDRITAVKTVTPTAEWVYDLEVEGTHAYLTNGVLSHN

SEQ ID NO: 139 - protein, 483 aa, Artificial Sequence
  Synthetic construct Hwa:O59_6
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKESPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLDVTDALTTDRITAVKTVTPTAEWVYDLEVEGTHAYLTNGVLSHN

SEQ ID NO: 140 - protein, 483 aa, Artificial Sequence
  Synthetic construct Hwa:O59_7
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLHPISVDNTANTLNPRSMSTPGITTDGGLYRTGSDGGIVHAEVGKEDVTDALTTDRITAVKTVTPTAEWVYDLEVEGTHAYLTNGVLSHN

SEQ ID NO: 141 - protein, 483 aa, Artificial Sequence
  Synthetic construct Hwa:O59_8
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLVADSHPISVDNTANTLNPRSMSTPGITTDGGLYRTGSDGGIVHAEVGKEDVTDALTTDRITAVKTVTPTAEWVYDLEVEGTHAYLTNGVLSHN

SEQ ID NO: 142 - protein, 483 aa, Artificial Sequence
  Synthetic construct Hwa:O59_9
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDASPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLLTTDRITAVKTVTPTAEWVYDLEVEGTHAYLTNGVLSHN

SEQ ID NO: 143 - protein, 410 aa, Artificial Sequence
  Synthetic construct mTth:O59_1
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLRDVETGEVLWDPIVAVEPAGKARTFDLRVPPFANFVSEDLVVHN

SEQ ID NO: 144 - protein, 410 aa, Artificial Sequence
  Synthetic construct mTth:O59_2
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLLWDPIVAVEPAGKARTFDLRVPPFANFVSEDLVVHN

SEQ ID NO: 145 - protein, 418 aa, Artificial Sequence
  Synthetic construct mTth:O59_3
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLRDVETGEVLWDPIVAVEPAGKARTFDLRVPPFANFVSEDLVVHN

SEQ ID NO: 146 - protein, 413 aa, Artificial Sequence
  Synthetic construct mTth:O59_4
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLRDVETGEVLWDPIVAVEPAGKARTFDLRVPPFANFVSEDLVVHN

SEQ ID NO: 147 - protein, 405 aa, Artificial Sequence
  Synthetic construct mTth:O59_5
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLLWDPIVAVEPAGKARTFDLRVPPFANFVSEDLVVHN

SEQ ID NO: 148 - protein, 405 aa, Artificial Sequence
  Synthetic construct mTth:O59_6
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLRDVETGEVLWDPIVAVEPAGKARTFDLRVPPFANFVSEDLVVHN

SEQ ID NO: 149 - protein, 354 aa, Bacillus lentus
  MISC_FEATURE (1)..(354): proSavinase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 150 - DNA, 2049 bp, Artificial Sequence
  Synthetic construct, iproSavS46-mTth-EU59
caaaagaaaaatatttaattggctttaatgagcaggaagctgtctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 151 - DNA, 2049 bp, Artificial Sequence
  Synthetic construct, iproSavS62:mTth:EU59
caaaagaaaaatatttaattggctttaatgagcaggaagctgtcagtgagtttgtagaacaagtagaggcaaatgacgaggtcgccattctctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 152 - DNA, 2049 bp, Artificial Sequence
  Synthetic construct, iproSavT77:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 153 - DNA, 2049 bp, Artificial Sequence
  Synthetic construct, iproSavS86:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 154 - DNA, 2049 bp, Artificial Sequence
  synthetic construct, iproSavS100:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 155 - DNA, 2049 bp, Artificial Sequence
  Synthetic construct, iproSavT109:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 156 - DNA, 2049 bp, Artificial Sequence
  Synthetic construct, iproSavS135:mTth: EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 157 - DNA, 2049 bp, Artificial Sequence
  Synthetic construct, iproSavT148:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 158 - DNA, 2049 bp, Artificial Sequence
  Synthetic construct, iproSavS166:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 159 - DNA, 2049 bp, Artificial Sequence
  Synthetic construct, iproSavT167:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 160 - DNA, 2049 bp, Artificial Sequence
  Synthetic construct, iproSavS196:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 161 - DNA, 2049 bp, Artificial Sequence
  Synthetic construct, iproSavS208:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 162 - DNA, 2049 bp, Artificial Sequence
  Synthetic construct, iproSavS239:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 163 - DNA, 2049 bp, Artificial Sequence
  Synthetic construct, iproSavT243:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 164 - DNA, 2049 bp, Artificial Sequence
  Synthetic construct, S269:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 165 - DNA, 2049 bp, Artificial Sequence
  Synthetic construct, iproSavT285:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagcttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 166 - DNA, 2049 bp, Artificial Sequence
  Synthetic construct, iproSavS293:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 167 - DNA, 2049 bp, Artificial Sequence
  Synthetic cosntruct, S317:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 168 - DNA, 2049 bp, Artificial Sequence
  Synthetic construct, iproSavT318:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 169 - DNA, 2049 bp, Artificial Sequence
  Synthetic construct, iproSavT329:mTth:EU59
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggcttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 170 - protein, 270 aa, Bacillus subtilis
  MISC_FEATURE (1)..(270): Savinase catalytic domain
MAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 171 - protein, 682 aa, Artificial Sequence
  Synthetic construct, iproSavS46-mTth:EU59
AEEAKEKYLIGFNEQEAVCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 172 - protein, 682 aa, Artificial Sequence
  Synthetic construct, iproSavS62-mTth:EU59
AEEAKEKYLIGFNEQEAVSEFVEQVEANDEVAILCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 173 - protein, 682 aa, Artificial Sequence
  Synthetic construct, iproSavT77-mTth:EU59
AEEAKEKYLIGFNEQEAVSEFVEQVEANDEVAILSEEEEVEIELLHEFECLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 174 - protein, 682 aa, Artificial Sequence
  Synthetic construct. iproSavS86-mTth:EU59
AEEAKEKYLIGFNEQEAVSEFVEQVEANDEVAILSEEEEVEIELLHEFETIPVLSVELCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 175 - protein, 682 aa, Artificial Sequence
  Synthetic construct, iproSavS100-mTth:EU59
AEEAKEKYLIGFNEQEAVSEFVEQVEANDEVAILSEEEEVEIELLHEFETIPVLSVELSPEDVDALELDPAICLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 176 - protein, 682 aa, Artificial Sequence
  Synthetic construct, iproSavT109-mTth:EU59
AEEAKEKYLIGFNEQEAVSEFVEQVEANDEVAILSEEEEVEIELLHEFETIPVLSVELSPEDVDALELDPAISYIEEDAEVCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 177 - protein, 682 aa, Artificial Sequence
  Synthetic construct, iproSavS135-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 178 - protein, 682 aa, Artificial Sequence
  Synthetic construct, iproSavT148-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 179 - protein, 682 aa, Artificial Sequence
  Synthetic construct, iproSavS166-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 180 - protein, 682 aa, Artificial Sequence
  Synthetic construct, iproSavT167-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 181 - protein, 682 aa, Artificial Sequence
  Synthetic construct, iproSavS196-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 182 - protein, 682 aa, Artificial Sequence
  Synthetic construct, iproSavS208-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 183 - protein, 682 aa, Artificial Sequence
  Synthetic construct, iproSavS239-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 184 - protein, 682 aa, Artificial Sequence
  Synthetic construct, iproSavT243-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 185 - protein, 682 aa, Artificial Sequence
  Synthetic construct, iproSavS269-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 186 - protein, 682 aa, Artificial Sequence
  Synthetic construct, iproSavT285-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 187 - protein, 682 aa, Artificial Sequence
  Synthetic construct, iproSavS293-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 188 - protein, 682 aa, Artificial Sequence
  Synthetic construct, iproSavS293-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSTYASLNGTSMATPHVAGAAALVKQKNPSWSNVQIRNHLKNTATSLGSTNLYGSGLVNAEAATR

SEQ ID NO: 189 - protein, 682 aa, Artificial Sequence
  Synthetic construct, iproSavT318-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTYASLNGTSMATPHVAGAAALVKQKNPSWSNVQIRNHLKNTATSLGSTNLYGSGLVNAEAATR

SEQ ID NO: 190 - protein, 682 aa, Artificial Sequence
  Synthetic construct, iproSavT329-mTth:EU59
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTPHVAGAAALVKQKNPSWSNVQIRNHLKNTATSLGSTNLYGSGLVNAEAATR

SEQ ID NO: 191 - DNA, 2292 bp, Artificial Sequence
  Synthetic construct intein-modified iproSavS135:mTth:O59_1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgagagatgttgagactggagaggttctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 192 - DNA, 2292 bp, Artificial Sequence
  Synthetic construct intein-modified iproSavS135:mTth:O59_2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 193 - DNA, 2316 bp, Artificial Sequence
  Synthetic construct intein-modified iproSavS135:mTth:O59_3
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgagagatgttgagactggagaggttctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 194 - DNA, 2301 bp, Artificial Sequence
  Synthetic construct intein-modified iproSavS135:mTth:O59_4
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgagagatgttgagactggagaggttctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 195 - DNA, 2277 bp, Artificial Sequence
  Synthetic construct intein-modified iproSavS135:mTth:O59_5
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 196 - DNA, 2277 bp, Artificial Sequence
  Synthetic construct intein-modified iproSavS135:mTth:O59_6
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgagagatgttgagactggagaggttctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 197 - DNA, 2361 bp, Artificial Sequence
  Synthetic construct intein-modified iproSavS317:Hwa:O59_1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcagaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggacgttactgattgcctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 198 - DNA, 2361 bp, Artificial Sequence
  Synthetic construct intein-modified iproSavS317:Hwa:O59_2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcagaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggacgttactgatgccctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 199 - DNA, 2376 bp, Artificial Sequence
  Synthetic construct intein-modified iproSavS317:Hwa:O59_3
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcaagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggacgttactgatgccctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 200 - DNA, 2376 bp, Artificial Sequence
  Synthetic construct intein-modified iproSavS317:Hwa:O59_4
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggtcgccgactcagacgttactgatgccctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 201 - DNA, 2376 bp, Artificial Sequence
  Synthetic construct intein-modified iproSavS317:Hwa:O59_5
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcagacgttactgatgccagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 202 - DNA, 2511 bp, Artificial Sequence
  Synthetic construct intein-modified iproSavS317:Hwa:O59_6
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggagagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggacgttactgatgccctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 203 - DNA, 2511 bp, Artificial Sequence
  Synthetic construct intein-modified iproSavS317:Hwa:O59_7
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcaagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgcacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgatgccctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 204 - DNA, 2511 bp, Artificial Sequence
  Synthetic construct intein-modified iproSavS317:Hwa:O59_8
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctggtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgatgccctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 205 - DNA, 2511 bp, Artificial Sequence
  Synthetic construct intein-modified iproSavS317:Hwa:O59_9
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgatgccagcccgattcgccgtgaagtttcccaagacctgttcaaccagtttaacctgttcgctcaatactcggcggcggcatactgtggcaaaaataatgacgcaccggcgggcaccaacatcacctgcacgggcaatgcctgtccggaagtggaaaaagcggatgccacctttctgtatagcttcgaagattctggcgttggtgatgtgacgggttttctggcgctggataacaccaataaactgattgttctgtcattccgtggttcacgctcgatcgaaaactggattggcaacctgaacttcgatctgaaagaaatcaacgacatctgctcaggctgtcgtggtcatgatggcttcaccagcagctggcgttcggtcgcagacaccctgcgtcagaaagtggaagatgctgttcgtgaacatccggactatcgcgtggtttttacgggtcacagcctgggcggtgcactggctaccgttgcaggtgcagatctgcgtggtaacggttatgatatcgatgtgtttagctatggcgcgccgcgtgtgggtaatcgtgcatttgctgaatttctgaccgttcagaccggcggcaccctgtaccgcatcacccatacgaacgatattgtcccgcgtctgccgccgcgcgaatttggttatagtcacagttccccggaatactggattaaatccggcacgctggtcccggtgacccgtaatgatattgtgaaaatcgaaggcattgacgccaccggcggtaacaatcaaccgaacatcccggacatcccggctcatctgtggtattttggtctgattggcacctgcctgctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 206 - DNA, 627 bp, Artificial Sequence
  Synthetic construct Hwa_MCM-1 codon optimized
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgattgcctcacaactgacaggatcaccgctgtgaagaccgtcacgccaacagctgagtgggtctacgatctggaggtggagggcacacacgcctacctcacaaacggggttctctcacacaac

SEQ ID NO: 207 - DNA, 1065 bp, Bacillus lentus
  misc_feature (1)..(1065): proSavinase
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 208 - DNA, 813 bp, Bacillus lentus
  misc_feature (1)..(813): Savinase catalytic domain
atggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 209 - protein, 764 aa, Artificial Sequence
  Synthetic construct intein-modified iproSavS135:mTth:O59_1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLRDVETGEVLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 210 - protein, 764 aa, Artificial Sequence
  Synthetic construct intein-modified iproSavS135:mTth:O59_2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 211 - protein, 772 aa, Artificial Sequence
  Synthetic construct intein-modified iproSavS135:mTth:O59_3
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLRDVETGEVLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 212 - protein, 767 aa, Artificial Sequence
  Synthetic construct intein-modified iproSavS135:mTth:O59_4
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLRDVETGEVLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 213 - protein, 759 aa, Artificial Sequence
  Synthetic construct intein-modified iproSavS135:mTth:O59_5
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 214 - protein, 759 aa, Artificial Sequence
  Synthetic construct intein-modified iproSavS135:mTth:O59_6
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLRDVETGEVLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 215 - protein, 787 aa, Artificial Sequence
  Synthetic construct intein-modified iproSavS317:Hwa:O59_1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLDVTDCLTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 216 - protein, 787 aa, Artificial Sequence
  Synthetic construct intein-modified iproSavS317:Hwa:O59_2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSEVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLDVTDALTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 217 - protein, 792 aa, Artificial Sequence
  Synthetic construct intein-modified iproSavS317:Hwa:O59_3
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLDVTDALTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 218 - protein, 792 aa, Artificial Sequence
  Synthetic construct intein-modified iproSavS317:Hwa:O59_4
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLVADSDVTDALTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 219 - protein, 792 aa, Artificial Sequence
  Synthetic construct intein-modified iproSavS317:Hwa:O59_5
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSDVTDASPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLLTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 220 - protein, 837 aa, Artificial Sequence
  Synthetic construct intein-modified iproSavS317:Hwa:O59_6
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKESPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLDVTDALTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 221 - protein, 837 aa, Artificial Sequence
  Synthetic construct intein-modified iproSavS317:Hwa:O59_7
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLHPISVDNTANTLNPRSMSTPGITTDGGLYRTGSDGGIVHAEVGKEDVTDALTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 222 - protein, 837 aa, Artificial Sequence
  Synthetic construct intein-modified iproSavS317:Hwa:O59_8
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDSPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLVADSHPISVDNTANTLNPRSMSTPGITTDGGLYRTGSDGGIVHAEVGKEDVTDALTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 223 - protein, 837 aa, Artificial Sequence
  Synthetic construct intein-modified iproSavS317:Hwa:O59_9
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDASPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCLLTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 224 - protein, 209 aa, Haloquadratum walsbyi DSM 16790
  MISC_FEATURE (1)..(209): Hwa_MCM-1
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDCLTTDRITAVKTVTPTAEWVYDLEVEGTHAYLTNGVLSHN

SEQ ID NO: 225 - DNA, 1008 bp, Artificial Sequence
  Synthetic construct mTth:P77Cd
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataac

SEQ ID NO: 226 - DNA, 2070 bp, Artificial Sequence
  Synthetic construct iproSavS135:mTth:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 227 - DNA, 2070 bp, Artificial Sequence
  Synthetic construct iproSavS269:mTth:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataactcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 228 - DNA, 2070 bp, Artificial Sequence
  Synthetic construct iproSavS293:mTth:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataacagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 229 - DNA, 2070 bp, Artificial Sequence
  Synthetic construct iproSavS317:mTth:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataactcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 230 - DNA, 2388 bp, Artificial Sequence
  Synthetic construct iproSavS312:mVMA-c:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcaggcctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccattccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccatgccagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 231 - DNA, 2388 bp, Artificial Sequence
  Synthetic construct iproSavS326:mVMA-c:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacagcctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccattccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccatgcctcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 232 - protein, 336 aa, Artificial Sequence
  Synthetic construct mTth:P77Cd
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHN

SEQ ID NO: 233 - protein, 690 aa, Artificial Sequence
  Synthetic construct iproSavS135:mTth:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 234 - protein, 690 aa, Artificial Sequence
  Synthetic construct iproSavS269:mTth:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 235 - protein, 690 aa, Artificial Sequence
  Synthetic construct iproSavS293:mTth:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 236 - protein, 690 aa, Artificial Sequence
  Synthetic construct iproSavS317:mTth:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHNSTYASLNGTSMATPHVAGAAALVKQKNPSWSNVQIRNHLKNTATSLGSTNLYGSGLVNAEAATR

SEQ ID NO: 237 - protein, 796 aa, Artificial Sequence
  Synthetic construct iproSavS312:mVMA-c:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQAFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHASTYPGSTYASLNGTSMATPHVAGAAALVKQKNPSWSNVQIRNHLKNTATSLGSTNLYGSGLVNAEAATR

SEQ ID NO: 238 - protein, 796 aa, Artificial Sequence
  Synthetic construct iproSavS326:mVMA-c:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTAFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHASMATPHVAGAAALVKQKNPSWSNVQIRNHLKNTATSLGSTNLYGSGLVNAEAATR

What is claimed is:

1. A multiprotein unit comprising:
   i) a modified intein comprising an N-terminal part of an intein, a C-terminal part of the intein and a first protein, wherein a carboxy terminus of the N-terminal part of the intein is fused to an amino terminus of the first protein, and a carboxy terminus of the first protein is fused to an amino terminus of the C-terminal part of the intein, and
   ii) a second protein comprising an N-extein and a C-extein, wherein a carboxy terminus of the N-extein is fused to an amino terminus of the N-terminal part of the modified intein, and a carboxy terminus of the C-terminal part of the modified intein is fused to an amino terminus of the C-extein, wherein an amino acid sequence of the N-terminal part of the modified intein starts with a cysteine and an amino acid sequence of the C-terminal part of the modified intein ends with an asparagine, the activity of the first protein and the second protein of the multiprotein unit is reduced or inhibited, and the modified intein effects splicing of the multiprotein unit and restores the activity of the first protein and the second protein, wherein the sequence of the modified intein has at least 90% sequence identity to the reference sequence selected from the group consisting of: SEQ ID NO: 14 [mTth:EU59], SEQ ID NO: 15 [Pho_RadA:EU59], SEQ ID NO: 16 [Tko_RadA:EU59], SEQ ID NO:143 [mTth:O59_1], SEQ ID NO: 144 [mTth:O59_2], SEQ ID NO:145 [mTth:O59_3], SEQ ID NO:146 [mTth:O59_4], SEQ ID NO:147 [mTth:O59_5], SEQ ID NO:148 [mTth:O59_6], and SEQ ID NO: 232 [mTth:P77Cd].

2. The multiprotein unit of claim 1, wherein the sequence of the modified intein has at least 90% sequence identity to the reference sequence of SEQ ID NO: 14 [mTth:EU59].

3. The multiprotein unit of claim 1, wherein the sequence of the multiprotein unit has at least 90% sequence identity to the reference sequence selected from the group consisting of: SEQ ID NO: 19 [NtEGS109:mTth:EU59], SEQ ID NO: 20 [NtEGT155:mTth:EU59], SEQ ID NO: 21 [NtEGS255:mTth:EU59], SEQ ID NO: 22 [NtEGS325:mTth:EU59], SEQ ID NO: 23 [NtEGC348:mTth:EU59], SEQ ID NO: 24 [NtEGS352:mTth:EU59], SEQ ID NO: 25 [NtEGS364:mTth:EU59], SEQ ID NO: 26 [NtEGT376:mTth:EU59], SEQ ID NO: 27 [NtEGS379:mTth:EU59], SEQ ID NO: 28 [P33S231:mTth:EU59] SEQ ID NO: 29 [P33S235:mTth:EU59], SEQ ID NO: 30 [P33S303:mTth:EU59], SEQ ID NO: 31 [P33S318:mTth:EU59], SEQ ID NO: 32 [AAQS121:mTth:EU59], SEQ ID NO: 33 [AAQS138:mTth:EU59], SEQ ID NO: 34 [AAQS140:mTth:EU59], SEQ ID NO: 35 [AAQS146:mTth:EU59], SEQ ID NO: 36 [AAQS179:mTth:EU59], SEQ ID NO: 37 [AAQS187:mTth:EU59], SEQ ID NO: 38 [AAQS222:mTth:EU59], SEQ ID NO: 39 [AAQS249:mTth:EU59], SEQ ID NO: 40 [AAQS251:mTth:EU59], SEQ ID NO: 41 [NtEGS352:mTth-c:EU59], SEQ ID NO: 42 [NtEGS364:mTth-c:EU59], SEQ ID NO: 43 [NtEGS149:Pho_RadA:EU59], SEQ ID NO: 44 [NtEGT179: Pho_RadA: EU59], SEQ ID NO: 45 [NtEGT200: Pho_RadA: EU59], SEQ ID NO: 46 [NtEGS352: Pho_RadA: EU59], SEQ ID NO: 47 [NtEGS149: Tko_RadA: EU59], SEQ ID NO: 48 [NtEGT179: Tko_RadA: EU59], SEQ ID NO: 49 [NtEGT200: Tko_RadA: EU59], SEQ ID NO: 50 [NtEGS352: Tko_RadA: EU59], SEQ ID NO: 171[iproSav S46:mTth:EU59], SEQ ID NO: 172 [iproSav S62:mTth:EU59], SEQ ID NO: 173 [iproSav T47:mTth:EU59], SEQ ID NO: 174 [iproSav S86:mTth:EU59], SEQ ID NO: 175 [iproSav S100:mTth:EU59], SEQ ID NO: 176 [iproSav T109:mTth:EU59], SEQ ID NO: 177 [iproSav S135:mTth:EU59], SEQ ID NO: 178 [iproSav T148:mTth:EU59], SEQ ID NO: 179 [iproSav S166:mTth:EU59], SEQ ID NO: 180 [iproSav T167:mTth:EU59], SEQ ID NO: 181 [iproSav S196:mTth:EU59], SEQ ID NO: 182 [iproSav 5208:mTth:EU59], SEQ ID NO: 183 [iproSav 5239:mTth:EU59], SEQ ID NO: 184 [iproSav T243:mTth:EU59], SEQ ID NO: 185 [iproSav 5269:mTth:EU59], SEQ ID NO: 186 [iproSav T285:mTth:EU59], SEQ ID NO: 187 [iproSav 5293:mTth:EU59], SEQ ID NO: 188 [iproSav 5317:mTth:EU59], SEQ ID NO: 189 [iproSav T318:mTth:EU59], SEQ ID NO: 190 [iproSav T329:mTth:EU59], SEQ ID NO: 209 [iproSavS135:mTth:O59_1], SEQ ID NO: 210 [iproSavS135:mTth:O59_2], SEQ ID NO: 211 [iproSavS135:mTth:O59_3], SEQ ID NO: 212 [iproSavS135:mTth:O59_4], SEQ ID NO: 213 [iproSavS135:mTth:O59_5], SEQ ID NO: 214 [iproSavS135:mTth:O59_6], SEQ ID NO: 233 [iproSavS135: mTth:P77Cd], SEQ ID NO: 234 [iproSavS269:mTth:P77Cd], SEQ ID NO: 235 [iproSavS293: mTth:P77Cd], and SEQ ID NO: 236 [iproSavS317: mTth:P77Cd].

4. The multiprotein unit of claim 3, wherein the sequence of the multiprotein unit has at least 90% sequence identity to the reference sequence selected from the group consisting of: SEQ ID NO: 23 [NtEGC348:mTth:EU59], SEQ ID NO: 24 [NtEGS352:mTth:EU59], and SEQ ID NO: 26 [NtEGT376:mTth:EU59].

5. The multiprotein unit of claim 1, wherein the protein selected as the first protein differs from the protein selected as the second protein.

6. The multiprotein unit of claim 1, wherein the sequence of the intein has at least 90% sequence identity to the reference sequence selected from the group consisting of: SEQ ID NO: 9 (mTth), SEQ ID NO: 10 (Pho_RadA), and SEQ ID NO: 11 (Tko_RadA).

7. The multiprotein unit of claim 1, wherein the modified intein is inducible to cause splicing of the multiprotein unit by exposure of the multiprotein unit to an induction condition.

8. The multiprotein unit of claim 7, wherein the induction condition is at least one condition selected from the group consisting of: an induction temperature, an induction pH, an induction light, an induction compound, an induction concentration of a compound, and an induction concentration of an ion.

9. The multiprotein unit of claim 1, wherein the modified intein splices spontaneously.

10. The multiprotein unit of claim 1, wherein the second protein is selected from the group consisting of: a protease, a phytase, an amylase, an invertase, a xylanase, an endoglucanase, an exoglucanase, a feruloyl esterase, a lipase, and a cellulase.

11. The multiprotein unit of claim 1, wherein the sequence of the second protein has at least 90% sequence identity to the reference sequence selected from the group consisting of: SEQ ID NO: 1[P29600], SEQ ID NO: 2[P33558], SEQ ID NO: 3[Q7WUM6; AAQ], SEQ ID NO: 4[P77853], SEQ ID NO: 5 [P77853Cd], SEQ ID NO: 6[EU591743], SEQ ID NO: 7 [077044; NtEG], SEQ ID NO: 8[059952], SEQ ID NO: 17 [Savinase catalytic domain], and SEQ ID NO: 149 [proSavinase].

12. The multiprotein unit of claim 1, wherein the multiprotein unit is encoded by at least one polynucleotide included in an expression cassette and expressed in a host organism.

13. The multiprotein unit of claim 12, wherein the multiprotein unit is expressed in the host selected from the group consisting of: a plant, a yeast, a bacterium, a mammalian cell, an insect cell, and a phage.

14. A multiprotein unit comprising:
i) a modified intein comprising an N-terminal part of an intein, a C-terminal part of the intein and a first protein, wherein a carboxy terminus of the N-terminal part of the intein is fused to an amino terminus of the first protein, and a carboxy terminus of the first protein is fused to an amino terminus of the C-terminal part of the intein, and
ii) a second protein comprising an N-extein and a C-extein, wherein a carboxy terminus of the N-extein is fused to an amino terminus of the N-terminal part of the modified intein, and a carboxy terminus of the C-terminal part of the modified intein is fused to an amino terminus of the C-extein, wherein an amino acid sequence of the N-terminal part of the modified intein starts with a cysteine and an amino acid sequence of the C-terminal part of the modified intein ends with an asparagine, the activity of the first protein and the second protein of the multiprotein unit is reduced or inhibited, and the modified intein effects splicing of the multiprotein unit and restores the activity of the first protein and the second protein, wherein the sequence of the multiprotein unit has at least 90% sequence identity to the reference sequence selected from the group consisting of: SEQ ID NO: 19 [NtEGS109:mTth:EU59], SEQ ID NO: 20 [NtEGT155:mTth:EU59], SEQ ID NO: 21 [NtEGS255:mTth:EU59], SEQ ID NO: 22 [NtEGS325:mTth:EU59], SEQ ID NO: 23 [NtEGC348:mTth:EU59], SEQ ID NO: 24 [NtEGS352:mTth:EU59], SEQ ID NO: 25 [NtEGS364:mTth:EU59], SEQ ID NO: 26 [NtEGT376:mTth:EU59], SEQ ID NO: 27 [NtEGS379:mTth:EU59], SEQ ID NO: 28 [P33S231:mTth:EU59] SEQ ID NO: 29 [P33S235:mTth:EU59], SEQ ID NO: 30 [P33S303:mTth:EU59], SEQ ID NO: 31 [P33S318:mTth:EU59], SEQ ID NO: 32 [AAQS121:mTth:EU59], SEQ ID NO: 33 [AAQS138:mTth:EU59], SEQ ID NO: 34 [AAQS140:mTth:EU59], SEQ ID NO: 35 [AAQS146:mTth:EU59], SEQ ID NO: 36 [AAQS179:mTth:EU59], SEQ ID NO: 37 [AAQS187:mTth:EU59], SEQ ID NO: 38 [AAQS222:mTth:EU59], SEQ ID NO: 39 [AAQS249:mTth:EU59], SEQ ID NO: 40 [AAQS251:mTth:EU59], SEQ ID NO: 41 [NtEGS352:mTth-c:EU59], SEQ ID NO: 42 [NtEGS364:mTth-c:EU59], SEQ ID NO: 43 [NtEGS149:Pho_RadA:EU59], SEQ ID NO: 44 [NtEGT179: Pho_RadA: EU59], SEQ ID NO: 45 [NtEGT200: Pho_RadA: EU59], SEQ ID NO: 46 [NtEGS352: Pho_RadA: EU59], SEQ ID NO: 47 [NtEGS149: Tko_RadA: EU59], SEQ ID NO: 48 [NtEGT179: Tko_RadA: EU59], SEQ ID NO: 49 [NtEGT200: Tko_RadA: EU59], SEQ ID NO: 50 [NtEGS352: Tko_RadA: EU59], SEQ ID NO: 171 [iproSav S46:mTth:EU59], SEQ ID NO: 172 [iproSav S62:mTth:EU59], SEQ ID NO: 173 [iproSav T47: mTth:EU59], SEQ ID NO: 174 [iproSav S86:mTth:EU59], SEQ ID NO: 175 [iproSav S100:mTth:EU59], SEQ ID NO: 176 [iproSav T109:mTth:EU59], SEQ ID NO: 177 [iproSav 5135:mTth:EU59], SEQ ID NO: 178 [iproSav T148:mTth:EU59], SEQ ID NO: 179 [iproSav 5166:mTth:EU59], SEQ ID NO: 180 [iproSav T167:mTth:EU59], SEQ ID NO: 181 [iproSav 5196:mTth:EU59], SEQ ID NO: 182 [iproSav 5208:mTth:EU59], SEQ ID NO: 183 [iproSav 5239:mTth:EU59], SEQ ID NO: 184 [iproSav T243:mTth:EU59], SEQ ID NO: 185 [iproSav 5269:mTth:EU59], SEQ ID NO: 186 [iproSav T285:mTth:EU59], SEQ ID NO: 187 [iproSav 5293:mTth:EU59], SEQ ID NO: 188 [iproSav 5317:mTth:EU59], SEQ ID NO: 189 [iproSav T318:mTth:EU59], SEQ ID NO: 190 [iproSav T329:mTth:EU59], SEQ ID NO: 209 [iproSavS135:mTth:O59_1], SEQ ID NO: 210 [iproSavS135:mTth:O59_2], SEQ ID NO: 211 [iproSavS135:mTth:O59_3], SEQ ID NO: 212 [iproSavS135:mTth:O59_4], SEQ ID NO: 213 [iproSavS135:mTth:O59_5], SEQ ID NO: 214 [iproSavS135:mTth:O59_6], SEQ ID NO: 233 [iproSavS135: mTth:P77Cd], SEQ ID NO: 234 [iproSavS269: mTth:P77Cd], SEQ ID NO: 235 [iproSavS293: mTth:P77Cd], and SEQ ID NO: 236 [iproSavS317: mTth:P77Cd].

15. The multiprotein unit of claim 14, wherein the sequence of the multiprotein unit has at least 90% sequence identity to the reference sequence selected from the group consisting of: SEQ ID NO: 23 [NtEGC348:mTth:EU59], SEQ ID NO: 24 [NtEGS352:mTth:EU59], and SEQ ID NO: 26 [NtEGT376:mTth:EU59].

* * * * *